US008420098B2

(12) United States Patent  (10) Patent No.: US 8,420,098 B2
Camphausen et al.  (45) Date of Patent: Apr. 16, 2013

(54) FIBRONECTIN BASED SCAFFOLD DOMAIN PROTEINS THAT BIND TO PCSK9

(75) Inventors: Ray Camphausen, Wayland, MA (US); Jonathan H. Davis, Auburndale, MA (US); Sharon T. Cload, Cambridge, MA (US); Fabienne M. Denhez, Arlington, MA (US); Amna Saeed-Kothe, West Roxbury, MA (US); Dasa Lipovsek, Cambridge, MA (US); Ching-Hsiung Frederick Lo, Pennington, NJ (US); Chee Meng Low, Allston, MA (US); Bowman Miao, Churchville, PA (US); Tracy S. Mitchell, Billerica, MA (US); Rex A. Parker, Titusville, NJ (US); Ginger C. Rakestraw, Cambridge, MA (US); Katie A. Russo, Watertown, MA (US); Doree F. Sitkoff, Dresher, PA (US)

(73) Assignee: Bristol-Myers Squibb Company, Princeton, NJ (US)

( * ) Notice: Subject to any disclaimer, the term of this patent is extended or adjusted under 35 U.S.C. 154(b) by 0 days.

(21) Appl. No.: 13/085,864

(22) Filed: Apr. 13, 2011

(65) Prior Publication Data

US 2012/0094909 A1  Apr. 19, 2012

Related U.S. Application Data

(60) Provisional application No. 61/323,562, filed on Apr. 13, 2010, provisional application No. 61/330,731, filed on May 3, 2010.

(51) Int. Cl.
*A61K 39/00* (2006.01)
*C07K 1/00* (2006.01)

(52) U.S. Cl.
USPC ........................................ 424/185.1; 530/382

(58) Field of Classification Search ........................ None
See application file for complete search history.

(56) References Cited

U.S. PATENT DOCUMENTS

| | | | |
|---|---|---|---|
| RE30,985 E | 6/1982 | Cartaya | |
| 4,560,655 A | 12/1985 | Baker | |
| 4,657,866 A | 4/1987 | Kumar | |
| 4,767,704 A | 8/1988 | Cleveland et al. | |
| 4,927,762 A | 5/1990 | Darfler | |
| 5,122,469 A | 6/1992 | Mather et al. | |
| 5,631,144 A | 5/1997 | Lemoine et al. | |
| 5,672,502 A | 9/1997 | Birch et al. | |
| 6,048,728 A | 4/2000 | Inlow et al. | |
| 6,207,446 B1 | 3/2001 | Szostak et al. | |
| 6,214,553 B1 | 4/2001 | Szostak et al. | |
| 6,258,558 B1 | 7/2001 | Szostak et al. | |
| 6,261,804 B1 | 7/2001 | Szostak et al. | |
| 6,518,018 B1 | 2/2003 | Szostak et al. | |
| 6,559,126 B2 | 5/2003 | Tournaire et al. | |
| 6,818,418 B1 | 11/2004 | Lipovsek et al. | |
| 6,927,762 B2 | 8/2005 | Lin | |
| 7,115,396 B2 | 10/2006 | Lipovsek et al. | |
| 2005/0287153 A1 | 12/2005 | Dennis | |
| 2007/0003549 A1 | 1/2007 | Ignatovich et al. | |
| 2007/0148126 A1 | 6/2007 | Chen et al. | |
| 2007/0207952 A1* | 9/2007 | Silva et al. | 514/12 |
| 2009/0299040 A1* | 12/2009 | Camphausen et al. | 530/395 |
| 2010/0233177 A1* | 9/2010 | Yowe et al. | 424/139.1 |
| 2012/0076799 A1* | 3/2012 | Sparrow et al. | 424/158.1 |

FOREIGN PATENT DOCUMENTS

| | | |
|---|---|---|
| WO | WO2008/066752 A2 | 6/2008 |
| WO | WO2008/125623 A2 | 10/2008 |
| WO | WO2009/083804 A2 | 7/2009 |
| WO | WO2009/133208 A1 | 11/2009 |

OTHER PUBLICATIONS

Parker et al. Antibody mimics based on human fibronectin type three domain engineered for thermostability and high-affinity binding to vascular endothelial growth factor receptor two. Protein Engineering, Design and Selection (Sep. 2005) 18 (9): 435-444.*
Reiss, S. , Sieber, M. , Oberle, V. , Wentzel, A. , Spangenberg, P., Claus, R., Kolmar, H. & Lösche, W. (2006) Inhibition of platelet aggregation by grafting RGD and KGD sequences on the structural scaffold of small disulfide-rich proteins. Platelets, 17(3), 153-157.*
Skolnick et al. From genes to protein structure and function: novel applications of computational approaches in the genomic era. Trends Biotechnol. 18(1):34-9, 2000.*
Attwood TK. Genomics. The Babel of bioinformatics. Science. 290(5491):471-473, 2000.*
Kuntz. Structure-based strategies for drug design and discovery. Science. 1992 257(5073):1078-1082.*
Miller et al Ligand binding to proteins: the binding landscape model. Protein Sci. Oct. 1997;6(10):2166-79.*
Koivunen et al. Identification of Receptor Ligands with Phage Display Peptide Libraries J Nucl Med; 40:883-888, 1999.*
Helms et al. Destabilizing loop swaps in the CDRs of an immunoglobulin VL domain. Protein Science 4:2073-2081, 1995.*
Data Uniprot (Online); Jul. 21, 1986, "RecName: Full=Fibronectin; Short=FN; AltName: Full=Cold-insoluble globulin; Short=CIG"; XP002640484; retrieved from EBI accession No. UNIPROT: P02751, Database accession No. P02751 Abstract.
Barnes, et al., "Methods for Growth of Cultured Cells in Serum-Free Medium", Analytical Biochem., vol. 102, pp. 255-270 (1980).
Batori, et al., "Exploring the potential of the monobody scaffold: effects of loop elongation on the stability of a fibronectin type III domain", Protein Engineering, vol. 15 (12), pp. 1015-1020 (2002).
Connell, Nancy D., "Expression systems for use in actinomycetes and related organisms", Curr. Opin. Biotech., vol. 12, pp. 446-449 (2001).
Getmanova, et al. "Antagonists to Human and Mouse Vascular Endothelial Growth Factor Receptor 2 Generated by directed Protein Evolution In Vitro", Chemistry Biol., vol. 13, pp. 549-556 (2006).

(Continued)

*Primary Examiner* — Maher Haddad
(74) *Attorney, Agent, or Firm* — Paul D. Gollian; Melissa Miller

(57) ABSTRACT

The present invention relates to fibronectin based scaffold domain proteins that bind PCSK9. The invention also relates to the use of the innovative proteins in therapeutic applications to treat atherosclerosis, hypercholesterolemia and other cholesterol related diseases. The invention further relates to cells comprising such proteins, polynucleotides encoding such proteins or fragments thereof, and to vectors comprising the polynucleotides encoding the innovative protein.

8 Claims, 45 Drawing Sheets

OTHER PUBLICATIONS

Koide, et al., "Stabilization of a Fibronectin Type III Domain by the Removal of Unfavorable Electrostatic Interactions on the Protein Surface", Biochem., vol. 40, pp. 10326-10333 (2001).

Kwon, et al., "Molecular basis for LDL receptor recognition by PCSK9", PNAS, vol. 105 (6), pp. 1820-1825 (2008).

Lagace, et al., "Secreted PCSK9 decreases the number of LDL receptors in hepatocytes and in livers of parabiotic mice", J. Clin. Invest., vol. 116 (11), pp. 2995-3005 (2006).

Luckow, et al., "Trends in the development of baculovirus expression vectors", Biotechnology, vol. 6, pp. 47-55 (1988).

Makrides, Savvas C., "Strategies for Achieving High-Level Expression of Genes in *Escherichia coli*", Microbiological Reviews, vol. 60 (3), pp. 512-538 (1996).

Maxwell, et al., "Overexpression of PCSK9 accelerates the degradation of the LDLR in a post-endoplasmic reticulum compartment", PNAS, vol. 102 (6), pp. 2069-2074 (2005).

Mayfield, et al., "Expression and assembly of a fully active antibody in algae", PNAS, vol. 100 (2), pp. 438-442 (2003).

Miao, et al., "Ligand-Induced Coactivator Recruitment to Peroxisome Proliferator-Activated Receptorα Characterized by Fluorescence Resonance Energy Transfer", Methods Enzymol., vol. 357, pp. 180-188 (2002).

Naureckiene, et al., "Functional characterization of Narc 1, a novel proteinase related to proteinase K", Biochem. Biophysics, vol. 420, pp. 55-67 (2003).

Parker, et al., "Antibody mimics based on human fibronectin type three domain engineered for thermostability and high-affinity binding to vascular endothelial growth factor receptor two", Protein Engineering, Design & Selection, vol. 18 (9), pp. 435-444 (2005).

Rashid, et al., "Decreased plasma cholesterol and hypersensitivity to statins in mice lacking Pcsk9", PNAS, vol. 102 (15), pp. 5374-5379 (2005).

Roberts, et al., "RNA-peptide fusions for the in vitro selection of peptides and proteins", PNAS, vol. 94, pp. 12297-12302 (1997).

Sharp, et al., "Synonymous Codon Usage in *Saccharomyces cerevisiae*", Yeast, vol. 7, pp. 657-678 (1991).

Sinclair, et al., "Synonymous codon usage bias and the expression of human glucocerebrosidase in the methylotrophic yeast, *Pichia pastoris*", Protein Expression Purification, vol. 26, pp. 96-105 (2002).

Teupser, et al., "Determination of LDL-and scavenger-receptor activity in adherent and non-adherent cultured cells with a new single-step fluorometric assay", Biochimica et Biophysica Acta, vol. 1313, pp. 193-198 (1996).

Xu, et al., "Directed Evolution of High-Affinity Antibody Mimics Using mRNA Display", Chemistry & Biology, vol. 9, pp. 933-942 (2002).

Lipovšek, D., "Adnectins: engineered target-binding protein therapeutics", Protein Engineering, Design Selection, pp. 1-7, 2010 (doi:10.1093/protein/gzq097).

Ramamurthy, et al., "Structures of Adnectin/Protein Complexes Reveal an Expanded Binding Footprint", Structure, vol. 20, pp. 259-269 (2012).

* cited by examiner

FIG. 1

```
1459D05         MGVSDVPRDLEVVAATPTSLLISWPPPSHGYGYYRITYGETGGNSPVQEFTVPPGKGTAT
1784F03         MGVSDVPRDLEVVAATPTSLLISWRPPIHAYGYYRITYGETGGNSPVQEFTVPIVEGTAT
1784F03-m1      MGVSDVPRDLEVVAATPTSLLISWDAPIHAYGYYRITYGETGGNSPVQEFTVPGSEGTAT
1784F03-m2      MGVSDVPRDLEVVAATPTSLLISWDAPAHAYGYYRITYGETGGNSPVQEFTVPGSKGTAT
1784F03-m3      MGVSDVPRDLEVVAATPTSLLISWDAPAVTYGYYRITYGETGGNSPVQEFTVPGSKSTAT
1813E02         MGVSDVPRDLEVVAATPTSLLISWSPPANGYGYYRITYGETGGNSPVQEFTVPVGRGTAT
1923B02         MGVSDVPRDLEVVAATPTSLLISWTPPPKGYGYYRITYGETGGNSPVQEFTVPVGEGTAT
1923B02_N82I    MGVSDVPRDLEVVAATPTSLLISWTPPPKGYGYYRITYGETGGNSPVQEFTVPVGEGTAT
1923B02_N82E    MGVSDVPRDLEVVAATPTSLLISWTPPPKGYGYYRITYGETGGNSPVQEFTVPVGEGTAT
1923B02_T80A    MGVSDVPRDLEVVAATPTSLLISWTPPPKGYGYYRITYGETGGNSPVQEFTVPVGEGTAT
1922G04         MGVSDVPRDLEVVAATPTSLLISWRPPSHAYGYYRITYGETGGNSPVQEFTVPIGKGTAT
1922G04_R25D    MGVSDVPRDLEVVAATPTSLLISWDPPSHAYGYYRITYGETGGNSPVQEFTVPIGKGTAT
1922G04_R25E    MGVSDVPRDLEVVAATPTSLLISWEPPSHAYGYYRITYGETGGNSPVQEFTVPIGKGTAT
1922G04_R25S    MGVSDVPRDLEVVAATPTSLLISWSPPSHAYGYYRITYGETGGNSPVQEFTVPIGKGTAT
2012A04         MGVSDVPRDLEVVAATPTSLLISWRPPSNGHGYYRITYGETGGNSPVQEFTVPVNEGTAT
2013E01         MGVSDVPRDLEVVAATPTSLLISWVPPSDDYGYYRITYGETGGNSPVQEFTVPIGKGTAT
2011H05         MGVSDVPRDLEVVAATPTSLLISWVPSSHAYGYYRITYGETGGNSPVQEFTVPVGVGTAT
2011H05_V23D    MGVSDVPRDLEVVAATPTSLLISWDPSSHAYGYYRITYGETGGNSPVQEFTVPVGVGTAT
2011H05_V23E    MGVSDVPRDLEVVAATPTSLLISWEPSSHAYGYYRITYGETGGNSPVQEFTVPVGVGTAT

1459D05         ISGLKPGVDYTITVYAVEYPYKHSGYYHRPISINYRTEIDKPSQHHHHHH(SEQ ID NO:39)
1784F03         ISGLKPGVDYTITVYAVEYTFKHSGYYHRPISINYRTEIDKPSQHHHHHH(SEQ ID NO:41)
1784F03-m1      ISGLKPGVDYTITVYAVEYTFKHSGYYHRPISINYRTEIDKPSQHHHHHH(SEQ ID NO:43)
1784F03-m2      ISGLKPGVDYTITVYAVEYTFKHSGYYHRPISINYRTEIDKPSQHHHHHH(SEQ ID NO:45)
1784F03-m3      ISGLKPGVDYTITVYAVEYTFKHSGYYHRPISINYRTEIDKPSQHHHHHH(SEQ ID NO:47)
1813E02         ISGLKPGVDYTITVYAVEYTYKGSGYYHRPISINYRTEIDKPSQHHHHHH(SEQ ID NO:49)
1923B02         ISGLKPGVDYTITVYAVEYTYNGAGYYHRPISINYRTEIDKPSQHHHHHH(SEQ ID NO:51)
1923B02_N82I    ISGLKPGVDYTITVYAVEYTYIGAGYYHRPISINYRTG---SGSHHHHHH(SEQ ID NO:53)
1923B02_N82E    ISGLKPGVDYTITVYAVEYTYEGAGYYHRPISINYRTG---SGSHHHHHH(SEQ ID NO:55)
1923B02_T80A    ISGLKPGVDYTITVYAVEYAYNGAGYYHRPISINYRTG---SGSHHHHHH(SEQ ID NO:57)
1922G04         ISGLKPGVDYTITVYAVEYPWKGSGYYHRPISINYRTEIDKPSQHHHHHH(SEQ ID NO:59)
1922G04_R25D    ISGLKPGVDYTITVYAVEYPWKGSGYYHRPISINYRTG---SGSHHHHHH(SEQ ID NO:61)
1922G04_R25E    ISGLKPGVDYTITVYAVEYPWKGSGYYHRPISINYRTG---SGSHHHHHH(SEQ ID NO:63)
1922G04_R25S    ISGLKPGVDYTITVYAVEYPWKGSGYYHRPISINYRTG---SGSHHHHHH(SEQ ID NO:65)
2012A04         ISGLKPGVDYTITVYAVEFPFKWSGYYHRPISINYRTEIDKPSQHHHHHH(SEQ ID NO:67)
2013E01         ISGLKPGVDYTITVYAVEFPWPHAGYYHRPISINYRTEIDKPSQHHHHHH(SEQ ID NO:69)
2011H05         ISGLKPGVDYTITVYAVEYAFEGAGYYHRPISINYRTEIDKPSQHHHHHH(SEQ ID NO:71)
2011H05_V23D    ISGLKPGVDYTITVYAVEYAFEGAGYYHRPISINYRTEIDKPSQHHHHHH(SEQ ID NO:73)
2011H05_V23E    ISGLKPGVDYTITVYAVEYAFEGAGYYHRPISINYRTEIDKPSQHHHHHH(SEQ ID NO:75)
```

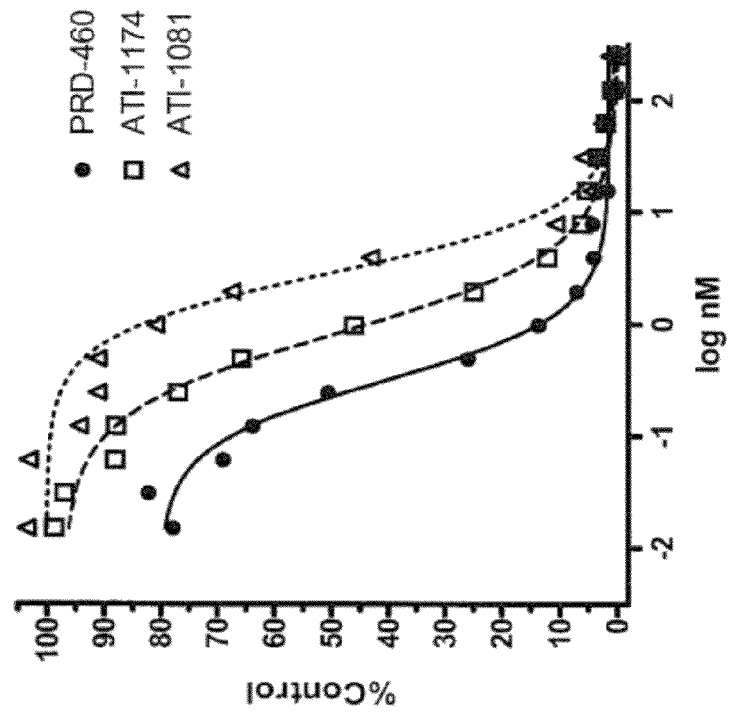
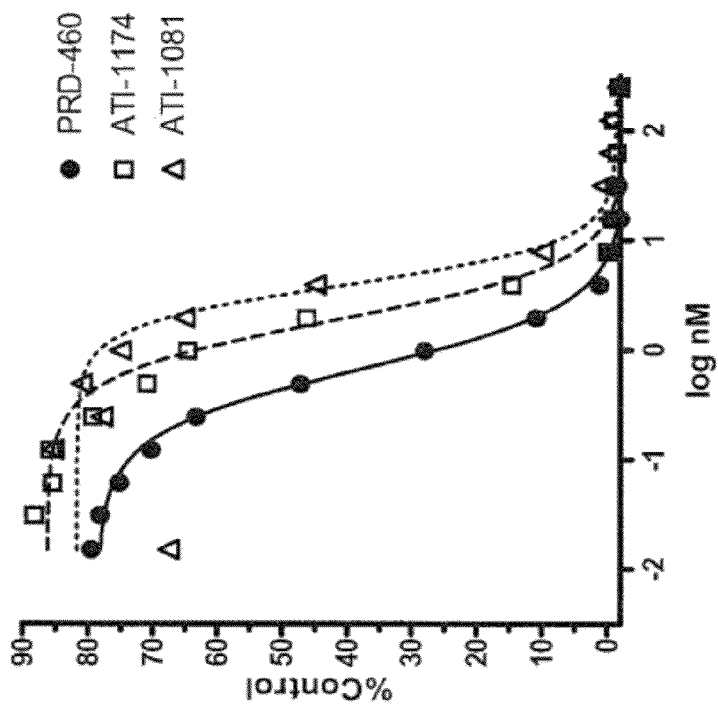
FIG. 14

FIBRONECTIN BASED SCAFFOLD DOMAIN PROTEINS THAT BIND TO PCSK9

SEQUENCE LISTING

The instant application contains a Sequence Listing which has been submitted in ASCII format via EFS-Web and is hereby incorporated by reference in its entirety. Said ASCII copy, created on Apr. 13, 2011, is named 20110413_SEQT_11594USNPST25.txt and is 1,382 KB in size.

FIELD OF THE INVENTION

The present invention relates to fibronectin based scaffold domain proteins that bind proprotein convertase subtilisin kexin type 9 (PCSK9). The invention also relates to the use of the innovative proteins in therapeutic applications to treat atherosclerosis, hypercholesterolemia and other cholesterol related diseases. The invention further relates to cells comprising such proteins, polynucleotides encoding such proteins or fragments thereof, and to vectors comprising the polynucleotides encoding the innovative proteins.

INTRODUCTION

Atherosclerosis is a disease of the arteries responsible for coronary heart disease (CHD) that underlies most deaths in industrialized countries (Lusis (2000)). Several risk factors for CHD have now been well established: dyslipidemias, hypertension, diabetes, smoking, poor diet, inactivity and stress. The most clinically relevant and common dyslipidemias are characterized by an increase in low density lipoprotein and very low density lipoproteins (LDL and VLDL) with hypercholesterolemia in the absence or presence of hypertriglyceridemia (Fredrickson et al. (1967)). An isolated elevation of LDL cholesterol is one of the most common risk factors for CHD. PCSK9 (also referred to as HCHOLA3, NARC-1, or FH3) is a protease belonging to the proteinase K subfamily of the secretory subtilase family (Naureckiene et al., Arch. Biochem. Biophy., 420:55-57 (2003)). PCSK9 has been shown to be a key regulator of cholesterol homeostasis and circulating low density lipoprotein levels. Circulating PCSK9 protein controls LDL metabolism by directly binding to the LDL receptor and promoting its degradation in hepatocytes. PCSK9-mediated down-regulation of LDL receptor protein and activity leads to reduced clearance of LDL from the circulation and higher LDL levels. Several mutant forms of PCSK9 are known, including S127R, N157K, F216L, R218S, and D374Y, with S127R, F216L, and D374Y being linked to autosomal dominant hypercholesterolemia (ADH). It is believed that wild-type PCSK9 increases the turnover rate of the LDL receptor causing lower LDL clearance (Maxwell et al., Proc. Natl. Acad. Sci., 102(6):2069-2074 (2005); Benjannet et al. and Lalanne et al.), while PCSK9 loss of function mutations result in increased levels of low density lipoprotein receptor (LDLR), increased clearance of circulating LDL, and a corresponding decrease in plasma cholesterol levels (Rashid et al., Proc. Natl. Acad. Sci., 102(15):5374-5379 (2005)). As such, PCSK9 is a potential target for the treatment of atherosclerosis, hypercholesterolemia and other cholesterol related diseases.

Fibronectin based scaffolds are a family of proteins capable of evolving to bind any compound of interest. These proteins, which generally make use of a scaffold derived from a fibronectin type III (Fn3) or Fn3-like domain, function in a manner characteristic of natural or engineered antibodies (that is, polyclonal, monoclonal, or single-chain antibodies) and, in addition, possess structural advantages. Specifically, the structure of these antibody mimics has been designed for optimal folding, stability, and solubility, even under conditions that normally lead to the loss of structure and function in antibodies. An example of fibronectin-based scaffold proteins is Adnectins (Adnexus, a Bristol-Myers Squibb R&D Company).

Fibronectin type III (Fn3) domains comprise, in order from N-terminus to C-terminus, a beta or beta-like strand, A; a loop, AB; a beta or beta-like strand, B; a loop, BC; a beta or beta-like strand C; a loop CD; a beta or beta-like strand D; a loop DE; a beta or beta-like strand, E; a loop, EF; a beta or beta-like strand F; a loop FG; and a beta or beta-like strand G. Any or all of loops AB, BC, CD, DE, EF and FG may participate in target binding. The BC, DE, and FG loops are both structurally and functionally analogous to the complementarity determining regions (CDRs) from immunoglobulins. U.S. Pat. No. 7,115,396 describes Fn3 domain proteins wherein alterations to the BC, DE, and FG loops result in high affinity TNFα binders. U.S. Publication No. 2007/0148126 describes Fn3 domain proteins wherein alterations to the BC, DE, and FG loops result in high affinity VEGFR2 binders.

It would be advantageous to obtain improved fibronectin domain scaffold proteins that bind PCSK9 for the therapeutic treatment of atherosclerosis, hypercholesterolemia and other cholesterol related diseases.

SUMMARY OF THE INVENTION

The application provides Adnectins against human PCSK9. One aspect of the invention provides for polypeptides comprising Fn3 domain in which one or more of the solvent accessible loops has been randomized or mutated. In some embodiments, the Fn3 domain is an Fn3 domain derived from the wild-type tenth module of the human fibronectin type III domain ($^{10}$Fn3). In some embodiments, the $^{10}$Fn3 polypeptide of the invention is at least 40%, 50%, 60%, 65%, 70%, 75%, 80%, 85%, or 90% identical to the human $^{10}$Fn3 domain.

In some embodiments, one or more loops selected from BC, DE, and FG may be extended or shortened in length relative to the corresponding human fibronectin loop.

In some embodiments, the polypeptides of the invention comprise a tenth fibronectin type III ($^{10}$Fn3) domain, wherein the $^{10}$Fn3 domain comprises a loop, AB; a loop, BC; a loop, CD; a loop, DE; a loop EF; and a loop FG; and has at least one loop selected from loop BC, DE, and FG with an altered amino acid sequence relative to the sequence of the corresponding loop of the human $^{10}$Fn3 domain.

In some embodiments, the polypeptide of the invention comprises an Fn3 domain that comprises an amino acid sequence at least 80, 85, 90, 95, 98, 99 or 100% identical to the non-loop regions.

In some embodiments, the BC loop of the protein of the invention comprises an amino acid sequence selected from the group consisting of SEQ ID NOs: 2-17, 106-135, and 301-303. In certain embodiments, the BC loop of the protein of the invention comprises the shaded portion of any one of SEQ ID NOs: 2-17, 106-135, and 301-303 as shown in Table 3. For example, in one embodiment, a BC loop comprises the sequence PPPSHGYG (residues 3-10 of SEQ ID NO: 2), DAPAHAYG (residues 3-10 of SEQ ID NO: 5), EPFSRLPGGGE (residues 3-13 of SEQ ID NO: 106), or DAPADGGYG (residues 3-11 of SEQ ID NO: 107).

In some embodiments, the DE loop of the protein of the invention comprises an amino acid sequence selected from the group consisting of SEQ ID NOs:18-27 and 136-141. In certain embodiments, the DE loop of the protein of the invention comprises the shaded portion of any one of SEQ ID NOs: 18-27 and 136-141 as shown in Table 3. For example, in one embodiment, a DE loop comprises the sequence PGKG (residues 2-5 of SEQ ID NO: 18), VGVG (residues 2-5 SEQ ID NO: 27), or VSKS (residues 2-5 of SEQ ID NO: 137).

In some embodiments, the FG loop of the protein of the invention comprises an amino acid sequence selected from the group consisting of SEQ ID NOs: 28-38 and 142-172. In certain embodiments, the DE loop of the protein of the invention comprises the shaded portion of any one of SEQ ID NOs: 28-38 and 142-172 as shown in Table 3. For example, in one embodiment, a FG loop comprises the sequence EYPYKHSGYYHR (residues 1-12 in SEQ ID NO: 28), EYPYDYSGYYHR (residues 1-12 in SEQ ID NO: 142), or EFDFVGAGYYHR (residues 1-12 in SEQ ID NO: 167).

In some embodiments, the $^{10}$Fn3 domain may begin and/or end with amino acid substitutions, insertions or deletions.

In some embodiments, the protein of the invention comprises one loop sequence from the BC loop sequences shown in SEQ ID NOs: 2-17, 106-135, and 301-303; one DE loop sequence shown in SEQ ID NOs:18-27 and 136-141; and one FG loop sequence shown in SEQ ID NOs:28-38 and 142-172. In certain embodiments, the protein of the invention comprises one BC loop sequence comprising the shaded portion of any one of SEQ ID NOs: 2-17, 106-135, and 301-303 as shown in Table 3; one DE loop sequence comprising the shaded portion of any one of SEQ ID NOs: 18-27 and 136-141 as shown in Table 3; and one FG loop sequence comprising the shaded portion of any one of SEQ ID NOs: 28-38 and 142-172 as shown in Table 3.

In some embodiments, the protein of the invention comprises a BC, DE and FG loop amino acid sequence at least 70, 75, 80, 85, 90, 95, 98, 99 or 100% identical to of any one of SEQ ID NOS:2-38, 106-172, and 301-303. In certain embodiments, the protein of the invention comprises a BC, DE and FG loop amino acid sequence at least 70, 75, 80, 85, 90, 95, 98, 99 or 100% identical to any of the shaded portions of the BC, DE, and FG loops as shown in Table 3, as described above.

In some embodiments, the anti-PCSK9 Adnectin comprises the amino acid sequence of any one of SEQ ID NOS: 39-76, 173-290, and 304-309.

In some embodiments, the anti-PCSK9 Adnectin comprises the Fn3 domain amino acid sequence from position 3-96 of any one of SEQ ID NOS:39-76, 173-290, and 304-309.

In one aspect, the present disclosure provides an anti-PCSK9 Adnectin comprising a BC loop having the sequence SW$(X_1)_ZX_2$G (SEQ ID NO: 323) where $X_1$ is any amino acid, Z is a number from 6-9, and $X_2$ is Y or H.

In one aspect, the present disclosure provides an anti-PCSK9 Adnectin comprising a DE loop having the sequence P$X_1X_1X_1X_3$T, (SEQ ID NO: 324) where $X_1$ is any amino acid and $X_3$ is G or S.

In one aspect, the present disclosure provides an anti-PCSK9 Adnectin comprising an FG loop having the sequence E$X_4X_1X_5X_1X_1X_6$GY$X_4$HRP (SEQ ID NO: 325), where $X_1$ is any amino acid; $X_4$ is Y or F; $X_5$ is Y, F, or W; and $X_6$ is S or A. In certain embodiments, $X_4$ and $X_5$ are aromatic residues, each independently selected from Y, F, W, or H.

In one aspect, the present disclosure provides an anti-PCSK9 Adnectin comprising a BC loop having the sequence SW$(X_1)_ZX_2$G (SEQ ID NO: 323), a DE loop having the sequence P$X_1X_1X_1X_3$T (SEQ ID NO: 324), and an FG loop having the sequence E$X_4X_1X_5X_1X_1X_6$GY$X_4$HRP (SEQ ID NO: 325) as defined herein.

In one aspect, the present disclosure provides an anti-PCSK9 Adnectin comprising a BC loop having the sequence SWEPFSRLPGGGE (SEQ ID NO: 106), a DE loop having the sequence P$X_1X_1X_1X_3$T (SEQ ID NO: 324), and an FG loop having the sequence E$X_4X_1X_5X_1X_1X_6$GY$X_4$HRP (SEQ ID NO: 325) as defined herein.

In one aspect, the present disclosure provides an anti-PCSK9 Adnectin comprising a BC loop having the sequence $(X_1)_ZX_2$G (SEQ ID NO: 449) where $X_1$ is any amino acid, Z is a number from 6-9, and $X_2$ is Y or H.

In one aspect, the present disclosure provides an anti-PCSK9 Adnectin comprising a DE loop having the sequence $X_1X_1X_1X_3$, (SEQ ID NO: 450) where $X_1$ is any amino acid and $X_3$ is G or S.

In one aspect, the present disclosure provides an anti-PCSK9 Adnectin comprising an FG loop having the sequence E$X_4X_1X_5X_1X_1X_6$GY$X_4$HR (SEQ ID NO: 451), where $X_1$ is any amino acid; $X_4$ is Y or F; $X_5$ is Y, F, or W; and $X_6$ is S or A. In certain embodiments, $X_4$ and $X_5$ are aromatic residues each independently selected from Y, F, W, or H.

In one aspect, the present disclosure provides an anti-PCSK9 Adnectin comprising a BC loop having the sequence $(X_1)_ZX_2$G (SEQ ID NO: 449), a DE loop having the sequence $X_1X_1X_1X_3$ (SEQ ID NO: 450), and an FG loop having the sequence E$X_4X_1X_5X_1X_1X_6$GY$X_4$HR (SEQ ID NO: 451) as defined herein.

In some embodiments, there is at least one amino acid deletion from the N-terminus of the PCSK9 Adnectin.

In some embodiments, there is at least one amino acid deletion, insertion or substitution from the C-terminus of the PCSK9 Adnectin.

In some embodiments, a linker is added to the C-terminus of the PCSK9 Adnectin.

In some embodiments, the PCSK9 Adnectin can be conjugated to a non-$^{10}$Fn3 moiety such as Human Serum Albumin (HSA) as described in PCT Publication Nos. WO 2009/133208 and WO 2009/083804.

In some embodiments, the PCSK9 Adnectin may have mutations in the AB, CD and EF loop amino acid sequences as described in PCT Publication Nos. WO 2009/133208 and WO 2009/083804.

In one aspect, the anti-PCSK9 Adnectin further comprises a pharmacokinetic (PK) moiety. In one embodiment, the PK moiety comprises polyethylene glycol (PEG). In certain embodiments, the PK moiety comprises an Fc region. In some embodiments, the PK comprises one or more serum albumin-binding Adnectins. Exemplary anti-PCSK9 Adnectin-Fc fusions proteins are shown in Table 1. Exemplary anti-PCSK9-serum albumin binding Adnectin comprise SEQ ID NO: 618 or 619.

In certain embodiments, an anti-PCSK9 Adnectin having a PK moiety comprises the sequence as set forth in SEQ ID NO: 322.

In another aspect, the anti-PCSK9 Adnectin does not comprise any PK moiety (i.e., a "naked" anti-PCSK9 Adnectin). In certain embodiments, the naked anti-PCSK9 Adnectin may be administered at a frequency that can sufficiently achieve the desired therapeutic effect. In another embodiment, the naked anti-PCSK9 Adnectin can be administered using an extended release formulation (e.g., subcutaneous formulation). In some embodiments, the extended release formulation increases the length of the absorption phase, or extends that pharmacodynamic effect, or both. Simply to illustrate, an extended release formulation comprises a propylene glycol/PBS solution.

In one aspect, the application provides an anti-PCSK9 Adnectin useful in the treatment of atherosclerosis, hypercholesterolemia and other cholesterol related diseases.

In one aspect, the present invention provides a fusion polypeptide comprising a fibronectin type III tenth ($^{10}$Fn3) domain that binds to serum albumin and an anti-PCSK9 Adnectin, wherein the serum albumin binding $^{10}$Fn3 domain binds to serum albumin, e.g., HSA, with a Kd of 1 uM or less. In certain embodiments, the $^{10}$Fn3 domain that binds to serum albumin comprises an amino acid sequence at least 70% identical to SEQ ID NO: 330. In one embodiment, the $^{10}$Fn3 domain that binds to serum albumin comprises a BC loop having the amino acid sequence set forth in SEQ ID NO: 331, a DE loop having the amino acid sequence set forth in SEQ ID NO: 332, and an FG loop having the amino acid sequence set forth in SEQ ID NO:333. In another embodiment, the $^{10}$Fn3 domain that binds to serum albumin comprises one or more of a BC loop having the amino acid sequence set forth in SEQ ID NO: 331, a DE loop having the amino acid sequence set forth in SEQ ID NO: 332, and an FG loop having the amino acid sequence set forth in SEQ ID NO: 333.

In one embodiment, the serum albumin binding $^{10}$Fn3 domain of the fusion polypeptide also binds to one or more of rhesus serum albumin (RhSA), cynomolgous monkey serum albumin (CySA), or murine serum albumin (MuSA). In other embodiments, the $^{10}$Fn3 domain that binds to serum albumin does not cross-react with one or more of RhSA, CySA or MuSA.

In certain embodiments, the serum albumin binding $^{10}$Fn3 domain of the fusion polypeptide binds to HSA with a Kd of 1 uM or less. In some embodiments, the serum albumin binding $^{10}$Fn3 domain binds to HSA with a Kd of 500 nM or less. In other embodiments, the serum albumin binding $^{10}$Fn3 domain binds to HSA with a Kd of at least 200 nM, 100 nM, 50 nM, 20 nM, 10 nM, or 5 nM.

In other embodiments, the serum albumin binding $^{10}$Fn3 domain of the fusion polypeptide binds to domain I or II of HSA. In one embodiment, the serum albumin binding $^{10}$Fn3 domain binds to both domains I and II of HSA. In some embodiments, the serum albumin binding $^{10}$Fn3 domain binds to HSA at a pH range of 5.5 to 7.4. In other embodiments, the serum albumin binding $^{10}$Fn3 domain binds to HSA with a Kd of 200 nM or less at pH 5.5. In another embodiment, the serum albumin binding Fn3 domain binds to HSA with a Kd of at least 500 nM, 200 nM, 100 nM, 50 nM, 20 nM, 10 nM, or 5 nM at a pH range of 5.5 to 7.4. In one embodiment, the serum albumin binding $^{10}$Fn3 domain binds to HSA with a Kd of at least 500 nM, 200 nM, 100 nM, 50 nM, 20 nM, 10 nM, or 5 nM at pH 5.5.

In some embodiments, the serum half-life of the fusion polypeptide in the presence of serum albumin is at least 5-fold greater than the serum half-life of the fusion polypeptide in the absence of serum albumin. In certain embodiments, the serum half-life of the fusion polypeptide in the presence of serum albumin is at least 2-fold, 5-fold, 7-fold, 10-fold, 12-fold, 15-fold, 20-fold, 22-fold, 25-fold, 27-fold, or 30-fold greater than the serum half-life of the fusion polypeptide in the absence of serum albumin. In some embodiments, the serum albumin is any one of HSA, RhSA, CySA, or MuSA.

In certain embodiments, the serum half-life of the fusion polypeptide in the presence of serum albumin is at least 20 hours. In certain embodiments, the serum half-life of the fusion polypeptide in the presence of serum albumin is at least 10 hours, 12 hours, 15 hours, 20 hours, 25 hours, 30 hours, 40 hours, 50 hours, 75 hours, 90 hours, 100 hours, 110 hours, 120 hours, 130 hours, 150 hours, 170 hours, or 200 hours. In some embodiments, the half-life of the fusion polypeptide is observed in a primate (e.g., human or monkey) or a mouse.

In any of the foregoing aspects and embodiments, the $^{10}$Fn3 domain that binds serum albumin comprises a sequence selected from SEQ ID NO: 334, 338, 342, 346, and 348-370.

BRIEF DESCRIPTION OF THE FIGURES

FIG. 1 shows an alignment of exemplary anti-PCSK9 Adnectin amino acid sequences. The BC, DE and FG loop amino acid sequences are identified by underlining, italics/underlining or bold/underlining, respectively.

FIG. 14. Inhibition of PCSK9:EGFA FRET assay (left panel) and PCSK9:ATI-972 FRET assay (right panel) by PCSK9 Adnectins.

FIG. 22. Effect of ATI-1081 dosed subcutaneously in PG vehicle in transgenic mice. The figure illustrates level of unbound hPCSK9 in transgenic mice.

DETAILED DESCRIPTION OF THE INVENTION

Definitions

Figure 2:
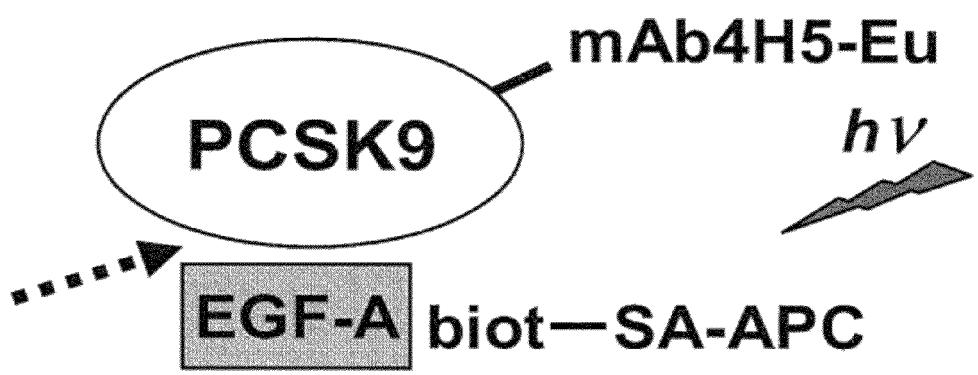
FIG. 2 is a schematic depicting the PCSK9: Epidermal Growth Factor precursor homology domain (EGFA domain) fluorescence resonance energy transfer (FRET) assay which was used to measure potency of PCSK9:LDLR inhibiting PCSK9 Adnectins as described in Example 2.

By a "polypeptide" is meant any sequence of two or more amino acids, regardless of length, post-translation modification, or function. "Polypeptide," "peptide," and "protein" are used interchangeably herein. Polypeptides can include natural amino acids and non-natural amino acids such as those described in U.S. Pat. No. 6,559,126, incorporated herein by reference. Polypeptides can also be modified in any of a variety of standard chemical ways (e.g., an amino acid can be modified with a protecting group; the carboxy-terminal amino acid can be made into a terminal amide group; the amino-terminal residue can be modified with groups to, e.g., enhance lipophilicity; or the polypeptide can be chemically glycosylated or otherwise modified to increase stability or in vivo half-life). Polypeptide modifications can include the attachment of another structure such as a cyclic compound or other molecule to the polypeptide and can also include polypeptides that contain one or more amino acids in an altered configuration (i.e., R or S; or, L or D). The peptides of the invention are proteins derived from the tenth type III domain of fibronectin that have been modified to bind specifically to PCSK9 and are referred to herein as, "anti-PCSK9 Adnectin" or "PCSK9 Adnectin".

The term "PK" is an acronym for "pharmacokinetic" and encompasses properties of a compound including, by way of example, absorption, distribution, metabolism, and elimination by a subject. A "PK modulation protein" or "PK moiety" refers to any protein, peptide, or moiety that affects the pharmacokinetic properties of a biologically active molecule when fused to or administered together with the biologically active molecule. Examples of a PK modulation protein or PK moiety include PEG, human serum albumin (HSA) binders (as disclosed in U.S. Publication Nos. 2005/0287153 and 2007/0003549, PCT Publication Nos. WO 2009/083804 and WO 2009/133208, and SABA molecules as described herein), human serum albumin, Fc or Fc fragments and variants thereof, and sugars (e.g., sialic acid).

"Percent (%) amino acid sequence identity" herein is defined as the percentage of amino acid residues in a candidate sequence that are identical with the amino acid residues in a selected sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN, ALIGN-2 or Megalign (DNASTAR®) software. Those skilled in the art can determine appropriate parameters for measuring alignment, including any algorithms needed to achieve maximal alignment over the full-length of the sequences being compared.

An "isolated" polypeptide is one that has been identified and separated and/or recovered from a component of its natural environment. Contaminant components of its natural environment are materials that would interfere with diagnostic or therapeutic uses for the polypeptide, and may include enzymes, hormones, and other proteinaceous or nonproteinaceous solutes. In preferred embodiments, the polypeptide will be purified (1) to greater than 95% by weight of polypeptide as determined by the Lowry method, and most preferably more than 99% by weight, (2) to a degree sufficient to obtain at least residues of N-terminal or internal amino acid sequence by use of a spinning cup sequenator, or (3) to homogeneity by SDS-PAGE under reducing or nonreducing condition using Coomassie blue or, preferably, silver stain. Isolated polypeptide includes the polypeptide in situ within recombinant cells since at least one component of the polypeptide's natural environment will not be present. Ordinarily, however, isolated polypeptide will be prepared by at least one purification step.

The notations "mpk", "mg/kg", or "mg per kg" refer to milligrams per kilogram. All notations are used interchangeably throughout the present disclosure.

The "half-life" of an amino acid sequence or compound can generally be defined as the time taken for the serum concentration of the polypeptide to be reduced by 50%, in vivo, for example due to degradation of the sequence or compound and/or clearance or sequestration of the sequence or compound by natural mechanisms. The half-life can be determined in any manner known per se, such as by pharmacokinetic analysis. Suitable techniques will be clear to the person skilled in the art, and may for example generally involve the steps of suitably administering to the primate a suitable dose of the amino acid sequence or compound of the invention; collecting blood samples or other samples from said primate at regular intervals; determining the level or concentration of the amino acid sequence or compound of the invention in said blood sample; and calculating, from (a plot of) the data thus obtained, the time until the level or concentration of the amino acid sequence or compound of the invention has been reduced by 50% compared to the initial level upon dosing. Reference is, for example, made to the standard handbooks, such as Kenneth, A. et al., *Chemical Stability of Pharmaceuticals: A Handbook for Pharmacists* and in Peters et al., *Pharmacokinete Analysis: A Practical Approach* (1996). Reference is also made to Gibaldi, M. et al., *Pharmacokinetics*, 2nd Rev. Edition, Marcel Dekker (1982).

Half-life can be expressed using parameters such as the $t_{1/2}$-alpha, $t_{1/2}$-beta, HL_Lambda_z, and the area under the curve (AUC). In the present specification, an "increase in half-life" refers to an increase in any one of these parameters, any two of these parameters, any three of these parameters or all four of these parameters. An "increase in half-life" in particular refers to an increase in the $t_{1/2}$-beta and/or HL_Lambda_z, either with or without an increase in the $t_{1/2}$-alpha and/or the AUC or both.

Overview

This application provides Adnectins against human PCSK9. In order to identify PCSK9 specific antagonists, PCSK9 was presented to large synthetic libraries of Adnectins. Adnectins that bound to PCSK9 were screened for PCSK9 binding, for biophysical properties, and for PCSK9 inhibitory activity. The anti-PCSK9 Adnectins were mutated and subjected to further selective pressure by lowering the target concentration and selecting for anti-PCSK9 Adnectins with slow off-rates. From this optimization process, a family of Adnectins was identified as PCSK9 specific inhibitors with favorable biochemical and biophysical properties.

Fibronectin Based Scaffolds

One aspect of the application provides for polypeptides comprising Fn3 domain in which one or more of the solvent accessible loops has been randomized or mutated. In some embodiments, the Fn3 domain is an Fn3 domain derived from the wild-type tenth module of the human fibronectin type III domain ($^{10}$Fn3): VSDVPRDLEVVAATPTSLLI SWDAPAVTVRYYRITYGETGGNSPVQEFTV PGSKSTATISGLKPGVDYTITVYAV TGRGDSPASSKPISINYRT (SEQ ID NO: 1). In the $^{10}$Fn3 sequence, the BC, DE and FG loops are underlined.

As described herein, non-ligand binding sequences of $^{10}$Fn3, i.e., the "$^{10}$Fn3 scaffold", may be altered provided that the $^{10}$Fn3 retains ligand binding function and/or structural stability. A variety of mutant $^{10}$Fn3 scaffolds have been reported. In one aspect, one or more of Asp 7, Glu 9, and Asp 23 is replaced by another amino acid, such as, for example, a non-negatively charged amino acid residue (e.g., Asn, Lys, etc.). These mutations have been reported to have the effect of promoting greater stability of the mutant $^{10}$Fn3 at neutral pH as compared to the wild-type form (See, PCT Publication No. WO 02/04523). A variety of additional alterations in the $^{10}$Fn3 scaffold that are either beneficial or neutral have been disclosed. See, for example, Batori et al., *Protein Eng.*, 15(12):1015-1020 (December 2002); Koide et al., *Biochemistry*, 40(34):10326-10333 (Aug. 28, 2001).

Both variant and wild-type $^{10}$Fn3 proteins are characterized by the same structure, namely seven beta-strand domain sequences designated A through G and six loop regions (AB loop, BC loop, CD loop, DE loop, EF loop, and FG loop) which connect the seven beta-strand domain sequences. The beta strands positioned closest to the N- and C-termini may adopt a beta-like conformation in solution. In SEQ ID NO:1, the AB loop corresponds to residues 15-16, the BC loop corresponds to residues 21-30, the CD loop corresponds to residues 39-45, the DE loop corresponds to residues 51-56, the EF loop corresponds to residues 60-66, and the FG loop corresponds to residues 76-87 (Xu et al., *Chemistry & Biology*, 9:933-942 (2002)).

In some embodiments, the $^{10}$Fn3 polypeptide may be at least 40%, 50%, 60%, 65%, 70%, 75%, 80%, 85%, or 90% identical to the human $^{10}$Fn3 domain, shown in SEQ ID NO:1. Much of the variability will generally occur in one or more of the loops. Each of the beta or beta-like strands of a $^{10}$Fn3 polypeptide may consist essentially of an amino acid sequence that is at least 80%, 85%, 90%, 95% or 100% identical to the sequence of a corresponding beta or beta-like strand of SEQ ID NO:1, provided that such variation does not disrupt the stability of the polypeptide in physiological conditions.

In some embodiments, the disclosure provides polypeptides comprising a tenth fibronectin type III ($^{10}$Fn3) domain, wherein the $^{10}$Fn3 domain comprises a loop, AB; a loop, BC; a loop, CD; a loop, DE; a loop EF; and a loop FG; and has at least one loop selected from loop BC, DE, and FG with an altered amino acid sequence relative to the sequence of the corresponding loop of the human $^{10}$Fn3 domain. In some embodiments, the BC and FG loops are altered, and in some embodiments, the BC, DE, and FG loops are altered, i.e., the Fn3 domains comprise non-naturally occurring loops. In some embodiments, the AB, CD and/or the EF loops are altered. By "altered" is meant one or more amino acid sequence alterations relative to a template sequence (corresponding human fibronectin domain) and includes amino acid additions, deletions, and substitutions. Altering an amino acid sequence may be accomplished through intentional, blind, or spontaneous sequence variation, generally of a nucleic acid coding sequence, and may occur by any technique, for example, PCR, error-prone PCR, or chemical DNA synthesis.

In some embodiments, one or more loops selected from BC, DE, and FG may be extended or shortened in length relative to the corresponding human fibronectin loop.

In some embodiments, the length of the loop may be extended by 2-25 amino acids. In some embodiments, the length of the loop may be decreased by 1-11 amino acids. To optimize antigen binding, therefore, the length of a loop of $^{10}$Fn3 may be altered in length as well as in sequence to obtain the greatest possible flexibility and affinity in antigen binding.

In some embodiments, the polypeptide comprises a Fn3 domain that comprises an amino acid sequence at least 80, 85, 90, 95, 98, 99 or 100% identical to the non-loop regions of SEQ ID NO:1, wherein at least one loop selected from BC, DE, and FG is altered. In some embodiments, the altered BC loop has up to 10 amino acid substitutions, up to 4 amino acid deletions, up to 10 amino acid insertions, or a combination thereof. In some embodiments, the altered DE loop has up to 6 amino acid substitutions, up to 4 amino acid deletions, up to 13 amino acid insertions or a combination thereof. In some embodiments, the FG loop has up to 12 amino acid substitutions, up to 11 amino acid deletions, up to 25 amino acid insertions or a combination thereof.

As described above, amino acid residues corresponding to residues 21-30, 51-56, and 76-87 of SEQ ID NO: 1 define the BC, DE, and FG loops, respectively. However, it should be understood that not every residue within the loop region needs to be modified in order to achieve a $^{10}$Fn3 binder having strong affinity for a desired target (e.g., PCSK9).

For example, residues 21 (S) and 22 (W) of the BC loop as shown in SEQ ID NO: 1 do not need to be modified for binding PCSK9. That is, $^{10}$Fn3 domains with high affinity binding to PCSK9 may be obtained by modifying only residues 23-30 of loop BC as shown in SEQ ID NO: 1. This is demonstrated in the BC loops exemplified in Table 3, which indicates that only the residues spanning the shaded positions were altered. Therefore, in some embodiments, a BC loop according to this designation comprises the shaded portion of any one of SEQ ID NOs: 2-17, 106-135, and 301-303 as shown in Table 3. For example, in one embodiment, a BC loop may comprise the sequence PPPSHGYG (residues 3-10 of SEQ ID NO: 2), DAPAHAYG (residues 3-10 of SEQ ID NO: 5), EPFSRLPGGGE (residues 3-13 of SEQ ID NO: 106), or DAPADGGYG (residues 3-11 of SEQ ID NO: 107).

Similarly, positions 51 (P) and 56 (T) of loop DE as shown in SEQ ID NO: 1 do not need to be modified for binding PCSK9. That is, $^{10}$Fn3 domains with high affinity binding to PCSK9 may be obtained by modifying only residues 52-55 of loop DE as shown in SEQ ID NO: 1. This is demonstrated in the DE loops exemplified in Table 3, which indicates that only the residues spanning the shaded positions were altered. Therefore, in some embodiments, a DE loop according to this designation comprises the shaded portion of any one of SEQ ID NOs: 18-27 and 136-141, as shown in Table 3. For example, in one embodiment, a DE loop may comprise the sequence PGKG (residues 2-5 of SEQ ID NO: 18), VGVG (residues 2-5 SEQ ID NO: 27), or VSKS (residues 2-5 of SEQ ID NO: 137).

Likewise, position 87 (P) of the FG loop as shown in SEQ ID NO: 1 does not need to be modified for binding PCSK9. That is, $^{10}$Fn3 domains with high affinity binding to PCSK9 may be obtained by modifying only residues 76-86 of the FG loop as shown in SEQ ID NO: 1. This is demonstrated in the FG loops exemplified in Table 3, which indicates that only the residues spanning the shaded positions were altered. Therefore, in some embodiments, an FG loop according to this designation comprises the shaded portion of any one of SEQ ID NOs: 28-38 and 142-172, as shown in Table 3. For example, in one embodiment, an FG loop may comprise the sequence EYPYKHSGYYHR (residues 1-12 in SEQ ID NO: 28), EYPYDYSGYYHR (residues 1-12 in SEQ ID NO: 142), or EFDFVGAGYYHR (residues 1-12 in SEQ ID NO: 167).

In some embodiments, the present application demonstrates that the BC, DE, and FG loop regions can be generally described according to consensus sequences. For example, the BC loop can be generally defined by the consensus sequence SW($X_1$)$_Z$$X_2$G (SEQ ID NO: 323) where $X_1$ is any amino acid, Z is a number from 6-9, and $X_2$ is Y or H. This consensus sequence is exemplified by BC loops shown in Table 3 except for the BC loop defined by SEQ ID NO: 106. In other embodiments, Z is a number selected from 2-5. In certain embodiments, Z is a number selected from 10-15. In some embodiments, $X_2$ is any aromatic residue (i.e., Y, F, W, or H).

In another embodiment, the DE loop can be generally defined by the consensus sequence P$X_1$$X_1$$X_1$$X_3$T, (SEQ ID NO: 324) where $X_1$ is any amino acid and $X_3$ is G or S. This consensus is exemplified by the DE loops shown in Table 3.

In another embodiment, the FG loop can be generally defined by the consensus sequence E$X_4$$X_1$$X_5$$X_1$$X_1$$X_6$GY$X_4$HRP (SEQ ID NO: 325), where $X_1$ is any amino acid; $X_4$ is Y or F; $X_5$ is Y, F, or W; and $X_6$ is S or A. In certain embodiments, $X_4$ and $X_5$ are aromatic residues, each independently selected from Y, F, W, or H. This consensus is exemplified by the FG loops shown in Table 3.

Accordingly, in certain embodiments, the present disclosure provides a PCSK9 binding Adnectin comprising a BC loop having the sequence SW($X_1$)$_Z$$X_2$G (SEQ ID NO: 323), a DE loop having the sequence P$X_1$$X_1$$X_1$$X_3$T (SEQ ID NO: 324), and an FG loop having the sequence E$X_4$$X_1$$X_5$$X_1$$X_1$$X_6$GY$X_4$HRP (SEQ ID NO: 325), as defined above.

In another embodiment, the present disclosure provides a PCSK9 binding Adnectin comprising a BC loop having the sequence SWEPFSRLPGGGE (SEQ ID NO: 106), a DE loop having the sequence P$X_1$$X_1$$X_1$$X_3$T (SEQ ID NO: 324), and an FG loop having the sequence E$X_4$$X_1$$X_5$$X_1$$X_1$$X_6$GY$X_4$HRP (SEQ ID NO: 325), as defined above.

In certain embodiments, a BC loop can be generally defined by the consensus sequence ($X_1$)$_Z$$X_2$G (SEQ ID NO: 449) where $X_1$ is any amino acid, Z is a number from 6-9, and $X_2$ is Y or H. This consensus sequence is exemplified by BC loops shown in Table 3 except for the BC loop defined by SEQ ID NO: 106. In other embodiments, Z is a number selected from 2-5. In certain embodiments, Z is a number selected from 10-15. In some embodiments, $X_2$ is any aromatic residue (i.e., Y, F, W, or H).

In certain embodiments, the DE loop can be generally defined by the consensus sequence $X_1$$X_1$$X_1$$X_3$, (SEQ ID NO: 450) where $X_1$ is any amino acid and $X_3$ is G or S. This consensus is demonstrated by the DE loops shown in Table 3.

In certain embodiments, the FG loop can be generally defined by the consensus sequence E$X_4$$X_1$$X_5$$X_1$$X_1$$X_6$GY$X_4$HR (SEQ ID NO: 451), where $X_1$ is any amino acid; $X_4$ is Y or F; $X_5$ is Y, F, or W; and $X_6$ is S or A. In some embodiments, $X_4$ and $X_5$ are aromatic residues, each independently selected from Y, F, W, or H. This consensus is exemplified by the FG loops shown in Table 3.

Accordingly, in one embodiment, the present disclosure provides a PCSK9 binding Adnectin having a BC loop comprising the sequence ($X_1$)$_Z$$X_2$G (SEQ ID NO: 449), a DE loop comprising the sequence $X_1$$X_1$$X_1$$X_3$ (SEQ ID NO: 450), and an FG loop comprising the sequence E$X_4$$X_1$$X_5$$X_1$$X_1$$X_6$GY$X_4$HR (SEQ ID NO: 451), as defined above.

In certain embodiments, antibody-like proteins based on the $^{10}$Fn3 scaffold can be defined generally by the following sequence:

(SEQ ID NO: 328)
EVVAAT(X)$_a$SLLI(X)$_x$YYRITYGE(X)$_b$QEFTV(X)$_y$ATI(X)$_c$DYTI
TVYAV(X)$_z$ISINYRT

In SEQ ID NO:328, the AB loop is represented by $X_a$, the CD loop is represented by $X_b$, the EF loop is represented by $X_e$, the BC loop is represented by $X_x$, the DE loop is represented by $X_y$, and the FG loop is represented by $X_z$. X represents any amino acid and the subscript following the X represents an integer of the number of amino acids. In particular, a may be anywhere from 1-15, 2-15, 1-10, 2-10, 1-8, 2-8, 1-5, 2-5, 1-4, 2-4, 1-3, 2-3, or 1-2 amino acids; and b, c, x, y and z may each independently be anywhere from 2-20, 2-15, 2-10, 2-8, 5-20, 5-15, 5-10, 5-8, 6-20, 6-15, 6-10, 6-8, 2-7, 5-7, or 6-7 amino acids. In preferred embodiments, a is 2 amino acids, b is 7 amino acids, c is 7 amino acids, x is 9 amino acids, y is 6 amino acids, and z is 12 amino acids. The sequences of the beta strands may have anywhere from 0 to 10, from 0 to 8, from 0 to 6, from 0 to 5, from 0 to 4, from 0 to 3, from 0 to 2, or from 0 to 1 substitutions, deletions or additions across all 7 scaffold regions relative to the corresponding amino acids shown in SEQ ID NO: 1. In an exemplary embodiment, the sequences of the beta strands may have anywhere from 0 to 10, from 0 to 8, from 0 to 6, from 0 to 5, from 0 to 4, from 0 to 3, from 0 to 2, or from 0 to 1 conservative substitutions across all 7 scaffold regions relative to the corresponding amino acids shown in SEQ ID NO: 1. In certain embodiments, the core amino acid residues are fixed and any substitutions, conservative substitutions, deletions or additions occur at residues other than the core amino acid residues.

In exemplary embodiments, the BC, DE, and FG loops as represented by $(X)_x$, $(X)_y$, and $(X)_z$, respectively, are replaced with polypeptides comprising the BC, DE and FG loop sequences from any of the PCSK9 binders shown in Table 3, or the shaded portions thereof, or the consensus sequences 323-325 or 449-451.

In certain embodiments, Antibody-like proteins based on the $^{10}$Fn3 scaffold can be defined generally by the sequence:

(SEQ ID NO: 329)
EVVAATPTSLLI(X)$_x$YYRITYGETGGNSPVQEFTV(X)$_y$ATISGLKPGV

DYTITVYAV(X)$_z$ISINYRT

In SEQ ID NO:329, the BC loop is represented by $X_x$, the DE loop is represented by $X_y$, and the FG loop is represented by $X_z$. X represents any amino acid and the subscript following the X represents an integer of the number of amino acids. In particular, x, y and z may each independently be anywhere from 2-20, 2-15, 2-10, 2-8, 5-20, 5-15, 5-10, 5-8, 6-20, 6-15, 6-10, 6-8, 2-7, 5-7, or 6-7 amino acids. In preferred embodiments, x is 9 amino acids, y is 6 amino acids, and z is 12 amino acids. The sequences of the beta strands may have anywhere from 0 to 10, from 0 to 8, from 0 to 6, from 0 to 5, from 0 to 4, from 0 to 3, from 0 to 2, or from 0 to 1 substitutions, deletions or additions across all 7 scaffold regions relative to the corresponding amino acids shown in SEQ ID NO: 1. In an exemplary embodiment, the sequences of the beta strands may have anywhere from 0 to 10, from 0 to 8, from 0 to 6, from 0 to 5, from 0 to 4, from 0 to 3, from 0 to 2, or from 0 to 1 conservative substitutions across all 7 scaffold regions relative to the corresponding amino acids shown in SEQ ID NO: 1. In certain embodiments, the core amino acid residues are fixed and any substitutions, conservative substitutions, deletions or additions occur at residues other than the core amino acid residues. In exemplary embodiments, the BC, DE, and FG loops as represented by $(X)_x$, $(X)_y$, and $(X)_z$, respectively, are replaced with polypeptides comprising the BC, DE and FG loop sequences from any of the PCSK9 binders shown in Table 3, or the shaded portions thereof, or the consensus sequences 323-325 or 449-451.

In certain embodiments, an anti-PCSK9 Adnectin described herein may comprise the sequence as set forth in SEQ ID NO: 328 or 329, wherein the BC, DE, and FG loops as represented by (X), $(X)_y$, and $(X)_z$, respectively, are replaced with a respective set of specified BC, DE, and FG loops from any of the clones in Table 3, or sequences at least 75%, 80%, 85%, 90%, 95%, 97%, 98%, or 99% identical to the BC, DE or FG loop sequences of the clones listed in Table 3. In exemplary embodiments, an anti-PCSK9 Adnectin as described herein is defined by SEQ ID NO: 329 and has a respective set of BC, DE and FG loop sequences from any of the clones listed in Table 3. For example, clone 1459D05 in Table 3 comprises BC, DE, and FG loops as set forth in SEQ ID NOs: 2, 18, and 28, respectively. Therefore, an anti-PCSK9 Adnectin based on these loops may comprise SEQ ID NO: 328 or 329, wherein $(X)_x$ comprises SEQ ID NO: 2, $(X)_y$ comprises SEQ ID NO: 18, and $(X)_z$ comprises SEQ ID NO: 28. Similar constructs are contemplated utilizing the set of BC, DE and FG loops from the other clones in Table 3, or the consensus sequences 323-325 or 449-451. The scaffold regions of such anti-PCSK9 Adnectin may comprise anywhere from 0 to 20, from 0 to 15, from 0 to 10, from 0 to 8, from 0 to 6, from 0 to 5, from 0 to 4, from 0 to 3, from 0 to 2, or from 0 to 1 substitutions, conservative substitutions, deletions or additions relative to the scaffold amino acids residues of SEQ ID NO: 1. Such scaffold modifications may be made, so long as the anti-PCSK9 Adnectin is capable of binding PCSK9 with a desired $K_D$.

In some embodiments, the BC loop of the protein of the invention comprises an amino acid sequence selected from the group consisting of SWPPPSHGYG (SEQ ID NO: 2), SWRPPIHAYG (SEQ ID NO: 3), SWDAPIHAYG (SEQ ID NO:4), SWDAPAHAYG (SEQ ID NO:5) and SWDAPAVTYG (SEQ ID NO:6), SWSPPANGYG (SEQ ID NO:7), SWTPPPKGYG (SEQ ID NO:8), SWRPPSHAYG (SEQ ID NO:9), SWDPPSHAYG (SEQ ID NO:10), SWEPPSHAYG (SEQ ID NO:11), SWSPPSHAYG (SEQ ID NO:12), SWRPPSNGHG (SEQ ID NO:13), SWVPPSDDYG (SEQ ID NO:14), SWVPSSHAYG (SEQ ID NO:15), SWDPSSHAYG (SEQ ID NO:16), and SWEPSSHAYG (SEQ ID NO:17). In further embodiments, the BC loop of the protein of the invention comprises an amino acid sequence selected from SEQ ID NOs: 106-135 and 301-303. In other embodiments, the BC loop of the protein of the invention comprises the shaded portion of any one of SEQ ID NOs: 2-17, 106-135, and 301-303 as shown in Table 3. For example, in one embodiment, a BC loop comprises the sequence PPPSHGYG (residues 3-10 of SEQ ID NO: 2), DAPAHAYG (residues 3-10 of SEQ ID NO: 5), EPFSRLPGGGE (residues 3-13 of SEQ ID NO: 106), or DAPADGGYG (residues 3-11 of SEQ ID NO: 107).

In some embodiments, the DE loop of the protein of the invention comprises an amino acid sequence selected from the group consisting of PPGKGT (SEQ ID NO:18), PIVEGT (SEQ ID NO:19), PGSEGT (SEQ ID NO:20), PGSKGT (SEQ ID NO:21), PGSKST (SEQ ID NO:22), PVGRGT (SEQ ID NO:23), PVGEGT (SEQ ID NO:24), PIGKGT (SEQ ID NO:25), PVNEGT (SEQ ID NO:26), and PVGVGT (SEQ ID NO:27). In further embodiments, the DE loop of the protein of the invention comprises an amino acid sequence selected from SEQ ID NOs: 136-141. In other embodiments, the DE loop of the protein of the invention comprises the shaded portion of any one of SEQ ID NOs: 18-27 and 136-141 as shown in Table 3. For example, in one embodiment, a DE loop comprises the sequence PGKG (residues 2-5 of SEQ ID NO: 18), VGVG (residues 2-5 SEQ ID NO: 27), or VSKS (residues 2-5 of SEQ ID NO: 137).

In some embodiments, the FG loop of the protein of the invention comprises an amino acid sequence selected from the group consisting of EYPYKHSGYYHRP (SEQ ID NO:28), EYTFKHSGYYHRP (SEQ ID NO:29), EYTYKGSGYYHRP (SEQ ID NO:30), EYTYNGAGYYHRP (SEQ ID NO:31), EYTYIGAGYYHRP (SEQ ID NO:32), EYTYEGAGYYHRP (SEQ ID NO:33), EYAYNGAGYYHRP (SEQ ID NO:34), EYPWKGSGYYHRP (SEQ ID NO:35), EFPFKWSGYYHRP (SEQ ID NO:36), EFPWPHAGYYHRP (SEQ ID NO:37) and EYAFEGAGYYHRP (SEQ ID NO:38). In further embodiments, the FG loop of the protein of the invention comprises an amino acid sequence selected from SEQ ID NOs: 142-172. In other embodiments, the FG loop of the protein of the invention comprises the shaded portion of any one of SEQ ID NOs: 28-38 and 142-172 as shown in Table 3. For example, in one embodiment, an FG loop comprises the sequence EYPYKH-SGYYHR (residues 1-12 in SEQ ID NO: 28), EYPYDYS-GYYHR (residues 1-12 in SEQ ID NO: 142), or EFDFV-GAGYYHR (residues 1-12 in SEQ ID NO: 167).

In some embodiments, the protein of the invention comprises one BC loop sequence selected from the BC loop sequences having SEQ ID NOs: 2-17, 106-135, and 301-303, or the shaded portion of any one of SEQ ID NOS: 2-17, 106-135, and 301-303, as shown in Table 3; one DE loop sequence selected from the DE loop sequences having SEQ ID NOs:18-27 and 136-141, or the shaded portion of any one of SEQ ID NOS:18-27 and 136-141 as shown in Table 3; and one FG loop sequence selected from the FG loop sequences having SEQ ID NOS: 28-38 and 142-172, or the shaded portion of any one of SEQ ID NOS: 28-38 and 142-172 as shown in Table 3. In some embodiments, the protein of the invention comprises a BC, DE and FG loop amino acid sequence at least 70, 75, 80, 85, 90, 95, 98, 99 or 100% identical to of any one of SEQ ID NOS: 2-38, 106-172, 301-303. In other embodiments, the protein of the invention comprises a BC, DE and FG loop amino acid sequence at least 70, 75, 80, 85, 90, 95, 98, 99 or 100% identical to the shaded portion of any one of SEQ ID NOS: 2-38, 106-172, 301-303 as shown in Table 3.

In some embodiments, the anti-PCSK9 Adnectin comprises the amino acid sequence of any one of SEQ ID NOS: 39-76, 173-290, and 304-309. In some embodiments, the anti-PCSK9 Adnectin comprises the Fn3 domain amino acid sequence from position 3-96 of any one of SEQ ID NOS: 39-76, 173-290, and 304-309. In some embodiments, the anti-PCSK9 Adnectin comprises an amino acid sequence at least 70, 75, 80, 85, 90, 95, 98, 99 or 100% identical to any one of SEQ ID NOS:39-76, 173-290, and 304-309.

Fibronectin naturally binds certain types of integrins through its integrin-binding motif, "arginine-glycine-aspartic acid" (RGD). In some embodiments, the polypeptide comprises a ¹⁰Fn3 domain that lacks the (RGD) integrin binding motif. The integrin binding domain may be removed by altering the RGD sequence by amino acid substitution, deletion or insertion.

In certain embodiments, the anti-PCSK9 Adnectin molecules of the present invention may be modified to comprise an N-terminal extension sequence and/or a C-terminal extension. For example, an MG sequence may be placed at the N-terminus of the ¹⁰Fn3 defined by SEQ ID NO: 1. The M will usually be cleaved off, leaving a G at the N-terminus. Alternatively, the first 10 amino acids of the anti-PCSK9 Adnectins shown in Table 4 may be replaced with an alternative N-terminal sequence, referred to herein as N-terminal extensions, as shown in Table 6 (i.e., SEQ ID NOs: 371-379). In addition, an M, G or MG may also be placed N-terminal to any of the N-terminal extensions having SEQ ID NOs: 371-379. The anti-PCSK9 Adnectins described herein may also comprise alternative C-terminal tail sequences, referred to herein as C-terminal extension sequences. For example, the anti-PCSK9 Adnectin sequences shown in Table 4 may be truncated at the threonine corresponding to T94 of SEQ ID NO: 1 (i.e., truncated after the INYRT (SEQ ID NO: 636) portion of the sequence). Such truncated version may be used as therapeutic molecules in the truncated form, or alternative C-terminal extensions may be added after the threonine residue. Exemplary C-terminal extension sequences are shown in Table 6 as SEQ ID NOs: 380-395. Exemplary anti-PCSK9 Adnectins comprising C-terminal extension sequences are shown in Table 4. For example, SEQ ID NO: 49 (clone 1813E02) comprises the naturally occurring C-terminal extension EIDKPSQ (SEQ ID NO: 380) followed by a His6 tag (SEQ ID NO: 637). However, it should be understood that the His6 tag is completely optional.

In certain embodiments, the C-terminal extension sequences (also called "tails"), comprise E and D residues, and may be between 8 and 50, 10 and 30, 10 and 20, 5 and 10, and 2 and 4 amino acids in length. In some embodiments, tail sequences include ED-based linkers in which the sequence comprises tandem repeats of ED. In exemplary embodiments, the tail sequence comprises 2-10, 2-7, 2-5, 3-10, 3-7, 3-5, 3, 4 or 5 ED repeats. In certain embodiments, the ED-based tail sequences may also include additional amino acid residues, such as, for example: EI (SEQ ID NO: 385), EID, ES, EC, EGS, and EGC. Such sequences are based, in part, on known Adnectin tail sequences, such as EIDKPSQ (SEQ ID NO: 380), in which residues D and K have been removed. In exemplary embodiments, the ED-based tail comprises an E, I or EI (SEQ ID NO: 385) residues before the ED repeats.

In other embodiments, the N- or C-terminal sequences may be combined with other known linker sequences (e.g., SEQ ID NO: 396-419 in Table 6) as necessary when designing an anti-PCSK9 Adnectin fusion molecule. Exemplary anti-PCSK9 Adnectin comprising linker sequences are shown in Table 4 (e.g., SEQ ID NOs: 53, 55, and 57). In some embodiments, sequences may be placed at the C-terminus of the ¹⁰Fn3 domain to facilitate attachment of a pharmacokinetic moiety. For example, a cysteine containing linker such as GSGC (SEQ ID NO:77) may be added to the C-terminus to facilitate site directed PEGylation on the cysteine residue.

Pharmacokinetic Moieties

In one aspect, the application provides for anti-PCSK9 Adnectins further comprising a pharmacokinetic (PK) moiety. Improved pharmacokinetics may be assessed according to the perceived therapeutic need. Often it is desirable to increase bioavailability and/or increase the time between doses, possibly by increasing the time that a protein remains available in the serum after dosing. In some instances, it is desirable to improve the continuity of the serum concentration of the protein over time (e.g., decrease the difference in serum concentration of the protein shortly after administration and shortly before the next administration). The anti-PCSK9 Adnectin may be attached to a moiety that reduces the clearance rate of the polypeptide in a mammal (e.g., mouse, rat, or human) by greater than three-fold relative to the unmodified anti-PCSK9 Adnectin. Other measures of improved pharmacokinetics may include serum half-life, which is often divided into an alpha phase and a beta phase. Either or both phases may be improved significantly by addition of an appropriate moiety.

Moieties that tend to slow clearance of a protein from the blood, herein referred to as "PK moieties", include polyoxyalkylene moieties, e.g., polyethylene glycol, sugars (e.g., sialic acid), and well-tolerated protein moieties (e.g., Fc and fragments and variants thereof, transferrin, or serum albumin). The anti-PCSK9 Adnectin may be fused to albumin or a fragment (portion) or variant of albumin as described in U.S. Publication No. 2007/0048282. In some embodiments, the PCSK9 Adnectin may be fused to one or more serum albumin binding Adnectin, as described herein.

In some embodiments, the PK moiety is a serum albumin binding protein such as those described in U.S. Publication Nos. 2007/0178082 and 2007/0269422.

In some embodiments, the PK moiety is a serum immunoglobulin binding protein such as those described in U.S. Publication No. 2007/0178082

In some embodiments, the anti-PCSK9 Adnectin comprises polyethylene glycol (PEG). One or more PEG molecules may be attached at different positions on the protein, and such attachment may be achieved by reaction with amines, thiols or other suitable reactive groups. The amine moiety may be, for example, a primary amine found at the N-terminus of a polypeptide or an amine group present in an amino acid, such as lysine or arginine. In some embodiments, the PEG moiety is attached at a position on the polypeptide selected from the group consisting of: a) the N-terminus; b) between the N-terminus and the most N-terminal beta strand or beta-like strand; c) a loop positioned on a face of the polypeptide opposite the target-binding site; d) between the C-terminus and the most C-terminal beta strand or beta-like strand; and e) at the C-terminus.

Pegylation may be achieved by site-directed pegylation, wherein a suitable reactive group is introduced into the protein to create a site where pegylation preferentially occurs. In some embodiments, the protein is modified to introduce a cysteine residue at a desired position, permitting site directed pegylation on the cysteine. PEG may vary widely in molecular weight and may be branched or linear. In one embodiment the PEG has two branches. In another embodiment the PEG has four branches.

In some embodiments, the anti-PCSK9 Adnectin is fused to an immunoglobulin Fc domain, or a fragment or variant thereof. In an exemplary embodiment, the Fc domain is derived from an IgG1 subclass, however, other subclasses (e.g., IgG2, IgG3, and IgG4) may also be used. Shown below is the sequence of a human IgG1 immunoglobulin Fc domain, and the relative position of each region within the Fc domain are indicated based on the EU numbering format:

(SEQ ID NO: 315)
*ASTKGPSVFPLAPSSKSTSGGTAALGCLVKDYFPEPVTVSWNSGALTSGV*

*HTFPAVLQSSGLYSLSSVVTVPSSSLGTQTYICNVNHKPSNTKVDKKVEP*

*KSC*DKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK

The core hinge sequence is underlined, and the CH1 region is italicized; the CH2 and CH3 regions are in regular text. It should be understood that the C-terminal lysine is optional.

The fusion may be formed by attaching an anti-PCSK9 Adnectin to either end of the Fc molecule, i.e., Fc-anti-PCSK9 Adnectin or anti-PCSK9 Adnectin-Fc arrangements. In certain embodiments, the Fc and anti-PCSK9 Adnectin are fused via a linker. Exemplary linker sequences include AGGGGSG (SEQ ID NO: 310), GSGSGSGSGSGS (SEQ ID NO: 311), QPDEPGGS (SEQ ID NO: 312), ELQLEESAAE-AQDGELD (SEQ ID NO: 313), TVAAPS (SEQ ID NO: 314), KAGGGGSG (SEQ ID NO: 620), KGSGSGSGSGSGS (SEQ ID NO: 621), KQPDEPGGS (SEQ ID NO: 622), KELQLEESAAEAQDGELD (SEQ ID NO: 623), KTVAAPS (SEQ ID NO: 624), KAGGGGSGG (SEQ ID NO: 625), KGSGSGSGSGSGSG (SEQ ID NO: 626), KQPDEPGGSG (SEQ ID NO: 627), KELQLEE-SAAEAQDGELDG (SEQ ID NO: 628), KTVAAPSG (SEQ ID NO: 629) AGGGGSGG (SEQ ID NO: 630), GSGSGSGSGSGSG (SEQ ID NO: 631), QPDEPGGSG (SEQ ID NO: 632), ELQLEESAAEAQDGELDG (SEQ ID NO: 633), and TVAAPSG (SEQ ID NO: 634).

In some embodiments, the Fc region used in the anti-PCSK9 Adnectin fusion comprises the hinge region of an Fc molecule. As used herein, the "hinge" region comprises the core hinge residues spanning positions 104-119 of SEQ ID NO: 315 (DKTHTCPPCPAPELLG; SEQ ID NO: 316) of IgG1, which corresponds to positions 221-236 according to EU numbering. In certain embodiments, the anti-PCSK9 Adnectin-Fc fusion adopts a multimeric structure (e.g., dimer) owing, in part, to the cysteine residues at positions 109 and 112 of SEQ ID NO: 315 (EU numbering 226 and 229, respectively) within the hinge region. In other embodiments, the hinge region as used herein, may further include residues derived from the CH1 and CH2 regions that flank the core hinge sequence, as shown in SEQ ID NO: 315.

In some embodiments, the hinge sequence, may include substitutions that confer desirable pharmacokinetic, biophysical, and/or biological properties. Some exemplary hinge sequences include EPKSSDKTHTCPPCPAPELLGGPS (SEQ ID NO: 317; core hinge region underlined), EPKSSDKTHTCPPCPAPELLGGSS (SEQ ID NO: 318; core hinge region underlined), EPKSSGSTHTCPPCPAPELLGGSS (SEQ ID NO: 319; core hinge region underlined), DKTHTCPPCPAPELLGGPS (SEQ ID NO: 320; core hinge region underlined), and DKTHTCPPCPAPELLGGSS (SEQ ID NO: 321, core hinge region underlined). In one embodiment, the residue P at position 122 (EU numbering 238) of SEQ ID NO: 315 has been replaced with S to ablate Fc effector function; this replacement is exemplified in hinges having any one of SEQ ID NOs: 318, 319, and 321. In another embodiment, the residues DK at positions 104-105 of SEQ ID NO: 315 (EU numbering 221-222) have been replaced with GS to remove a potential clip site; this replacement is exemplified in SEQ ID NO: 319. In another embodiment, the C at position 103 of SEQ ID NO: 315 (EU numbering 220) has been replaced with S to prevent improper cystine bond formation in the absence of a light chain; this replacement is exemplified in SEQ ID NOs: 317-319.

In certain embodiments, an antiPCSK9 Adnectin-Fc fusion may have the following configurations: 1) anti-PCSK9 Adnectin-hinge-Fc or 2) hinge-Fc-anti-PCSK9 Adnectin. Therefore, any anti-PCSK9 Adnectin of the present invention can be fused to an Fc region comprising a hinge sequence according to these configurations. In some embodiments, a linker may be used to join the anti-PCSK9 Adnectin to the hinge-Fc moiety, for example, an exemplary fusion protein may have the configuration hinge-anti-PCSK9 Adnectin-linker-Fc. Additionally, depending on the system in which the fusion polypeptide is produced, a leader sequence may placed at the N-terminus of the fusion polypeptide. For example, if the fusion is produced in a mammalian system, a leader sequence such as METDTLLLWVLLLWVPGSTG (SEQ ID NO: 326) may be added to the N-terminus of the fusion molecule. If the fusion is produced in *E. coli*, the fusion sequence will be preceded by a methionine.

The following sequence exemplifies an anti-PCSK9 Adnectin-hinge-Fc construct produced in a mammalian system: METDTLLLWVLLLWVPGSTGGVSDVPRDLEVVA ATPTSLLISWVPPSDDYGYYRITYGETGGNSPVQEFT VPIGKGTATISGLKPGVDYTITVYAVEFPWPHAGYYH RPISINYRT EIEPKSSGSTHTCPPCPAPELLGGSS VFLF-PPKPKDTLMISRTPEVTCVVVDVSHEDPEVKFNWYV DGVEVHNAKTKPREEQYNSTYRVVSVLTVLHQDWL NGKEYKCKVSNKALPAPIEKTISKAKGQPREPQVYT LPPSRDELTKNQVSLTCLVKGFYPSDIAVEWESNGQP ENNYKTTPPVLDSDGSFFLYSKLTVDKSRWQQGNVF SCSVMHEAL HNHYTQKSLSLSPGK (SEQ ID NO: 322). Here, the Fc domain comprises the human IgG1 CH2 and CH3 regions as follows: VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK (SEQ ID NO: 448) and the hinge sequence of SEQ ID NO:319. In SEQ ID NO: 322, the leader sequence is in bold, the anti-PCSK9 Adnectin sequence is in italics, and the hinge region is underlined. It should be understood that the lysine at the end of SEQ ID NO: 322 is optional. The efficacy of the polypeptide fusion as set forth in SEQ ID NO: 322 (also described herein as PRD460) is demonstrated in Example 4.

Exemplary PCSK9 Adnectin-Fc fusions are shown in Table 1. All sequences may begin with a methionine or a mammalian leader sequence (e.g., SEQ ID NO: 326).

TABLE 1

Exemplary Anti-PCSK9 Adnectin-Fc Fusion Proteins

| SEQ ID Name | Clone or Description | Sequence |
|---|---|---|
| PCSK9 Adnectin-$X_1$-Fc C-Terminal Fusions | | |
| 452 1459D05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWPPPSHGYGYYRITYGETGGNSPVQEFTVPPGKGTATISGLKPGVDYTITVYAVEYPYKHSGYYHRPISINYRT-$X_1$-$X_2$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| 453 1784F03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWRPPIHAYGYYRITYGETGGNSPVQEFTVPIVEGTATISGLKPGVDYTITVYAVEYTFKHSGYYHRPISINYRT-$X_1$-$X_2$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| 454 1784F03-m1-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPIHAYGYYRITYGETGGNSPVQEFTVPSEGTATISGLKPGVDYTITVYAVEYTFKHSGYYHRPISINYRT-$X_1$-$X_2$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| 455 1784F03-m2-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAHAYGYYRITYGETGGNSPVQEFTVPGSKGTATISGLKPGVDYTITVYAVEYTFKHSGYYHRPISINYRT-$X_1$-$X_2$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| 456 1784F03-m3-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally | GVSDVPRDLEVVAATPTSLLISWDAPAVTYGYYRITYGETGGNSPVQEFTVPGSKSTATISGLKPGVDYTITVYAVEYTFKHSGYYHRPISINYRT-$X_1$-$X_2$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSR |

TABLE 1-continued

Exemplary Anti-PCSK9 Adnectin-Fc Fusion Proteins

| SEQ ID | Clone or Name | Description | Sequence |
|---|---|---|---|
| | | include a C-terminal K | DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 457 | 1813E02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWSPPANG YGYYRITYGETGGNSPVQEFTVPVGRGTA TISGLKPGVDYTITVYAVEYTYKGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 458 | 1923B02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWTPPPKG YGYYRITYGETGGNSPVQEFTVPVGEGTA TISGLKPGVDYTITVYAVEYTYNGAGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPGK |
| 459 | 1923B02(N82I)- Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWTPPPKG YGYYRITYGETGGNSPVQEFTVPVGEGTA TISGLKPGVDYTITVYAVEYTYIGAGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 460 | 1923B02(N82E)- Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWTPPPKG YGYYRITYGETGGNSPVQEFTVPVGEGTA TISGLKPGVDYTITVYAVEYTYEGAGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 461 | 1923B02(T80A)- Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWTPPPKG YGYYRITYGETGGNSPVQEFTVPVGEGTA TISGLKPGVDYTITVYAVEYAYNGAGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 462 | 1922G04-Fc fusion | X1 is optional and when present can be selected from E, EI, EID, EIDK (SEQ ID NO: 384), EIE, and EIEK (SEQ ID NO: 635); X2 is | GVSDVPRDLEVVAATPTSLLISWRPPSHA YGYYRITYGETGGNSPVQEFTVPIGKGTA TISGLKPGVDYTITVYAVEYPWKGSGYYH RPISINYRT-X$_1$-X$_2$- VFLFPPKPKDTLMISRTPEVTCVVVDVSH |

TABLE 1-continued

Exemplary Anti-PCSK9 Adnectin-Fc Fusion Proteins

| SEQ ID Name | Clone or Description | Sequence |
|---|---|---|
| | selected from hinge sequences SEQ ID NOs: 317-321; the Fc may optionally include a C-terminal K | EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 463 1922G04(R25D)-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDPPSHA YGYYRITYGETGGNSPVQEFTVPIGKGTA TISGLKPGVDYTITVYAVEYPWKGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 464 1922G04(R25E)-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPPSHA YGYYRITYGETGGNSPVQEFTVPIGKGTA TISGLKPGVDYTITVYAVEYPWKGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 465 1922G04(R25S)-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWSPPSHA YGYYRITYGETGGNSPVQEFTVPIGKGTA TISGLKPGVDYTITVYAVEYPWKGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 466 2012A04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWRPPSNG HGYYRITYGETGGNSPVQEFTVPVNEGTA TISGLKPGVDYTITVYAVEFPFKWSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 467 2013E01-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWVPPSDD YGYYRITYGETGGNSPVQEFTVPIGKGTA TISGLKPGVDYTITVYAVEFPWPHAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |

TABLE 1-continued

Exemplary Anti-PCSK9 Adnectin-Fc Fusion Proteins

| SEQ ID Clone or Name | Description | Sequence |
|---|---|---|
| 468 2011H05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWVPSSHA YGYYRITYGETGGNSPVQEFTVPGVGTA TISGLKPGVDYTITVYAVEYAFEGAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 469 2011H05(V23D)-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDPSSHA YGYYRITYGETGGNSPVQEFTVPGVGTA TISGLKPGVDYTITVYAVEYAFEGAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 470 2011H05(V23E)-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPSSHA YGYYRITYGETGGNSPVQEFTVPGVGTA TISGLKPGVDYTITVYAVEYAFEGAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 471 2381B02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEYPYDYSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 472 2381B04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEYPYEHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 473 2381B06-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEYPYPHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN |

TABLE 1-continued

Exemplary Anti-PCSK9 Adnectin-Fc Fusion Proteins

| SEQ ID | Clone or Name | Description | Sequence |
|---|---|---|---|
| | | | GQPENNYKTTPPVLDSDGSFFLYSKLTVD KSRWQQGNVFSCSVMHEALHNHYTQKSLS LSPG |
| 474 | 2381B08-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG GYGYYRITYGETGGNSPVQEFTVPSSKGT ATISGLKPGVDYTITVYAVEYTFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 475 | 2381D02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEYPYDHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 476 | 2381D04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEFPYDHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 477 | 2381F11-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG GYGYYRITYGETGGNSPVQEFTVPVSKST ATISGLKPGVDYTITVYAVEYTFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 478 | 2381G03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEFPYAHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 479 | 2381G09-Fc fusion | X1 is optional and when present can be selected from E, EI, EID, EIDK (SEQ ID NO: 384), EIE, and EIEK (SEQ ID NO: 635); X2 is selected from hinge | GVSDVPRDLEVVAATPTSLLISWDAPAGD GYGYYRITYGETGGNSPVQEFTVPVSKGT ATISGLKPGVDYTITVYAVEFTFPGAGYY HRPISINYRT-$X_1$-$X_2$- VFLFPPKPKDTLMISRTPEVTCVVVDVSH EDPEVKFNWYVDGVEVHNAKTKPREEQYN |

TABLE 1-continued

Exemplary Anti-PCSK9 Adnectin-Fc Fusion Proteins

| SEQClone or ID Name | Description | Sequence |
|---|---|---|
| | sequences SEQ ID NOs: 317-321; the Fc may optionally include a C-terminal K | STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 4802381H03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWEPFSRL PGGGEYYRITYGETGGNSPLQQFTVPGSK GTATISGLKPGVDYTITVYAVEYPYAHSG YFHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 4812382A01-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWAAPAGG GYGYYRITYGETGGNSPVQEFTVPVSKGT ATISGLKPGVDYTITVYAVEYDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 4822382B10-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADA YGYYRITYGETGGNSPVQEFTVPSSKGTA TISGLKPGVDYTITVYAVEYDFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 4832382B09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADA YGYYRITYGETGGNSPVQEFTVPVSKGTA TISGLKPGVDYTITVYAVEFDYPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 4842382C05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG AYGYYRITYGETGGNSPVQEFTVPVSKGT ATISGLKPGVDYTITVYAVEYSFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |

TABLE 1-continued

Exemplary Anti-PCSK9 Adnectin-Fc Fusion Proteins

| SEQ ID | Clone or Name | Description | Sequence |
|---|---|---|---|
| 485 | 2382C09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEG YGYYRITYGETGGNSPVQEFTVPVSKGTA TISGLKPGVDYTITVYAVEFDFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 486 | 2382D03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADE AYGYYRITYGETGGNSPVQEFTVPVSKGT ATISGLKPGVDYTITVYAVEFDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 487 | 2382D05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG GYGYYRITYGETGGNSPVQEFTVPVSKGT ATISGLKPGVDYTITVYAVEFDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 488 | 2382D08-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG YGYYRITYGETGGNSPVQEFTVPVSKGTA TISGLKPGVDYTITVYAVEFPFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 489 | 2382D09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEG YGYYRITYGETGGNSPVQEFTVPVSKGTA TISGLKPGVDYTITVYAVEFDFPGAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 490 | 2382F02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG GYGYYRITYGETGGNSPVQEFTVPVSKGT ATISGLKPGVDYTITVYAVEFDFPGSGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN |

TABLE 1-continued

Exemplary Anti-PCSK9 Adnectin-Fc Fusion Proteins

| SEQ ID | Clone or Name | Description | Sequence |
|---|---|---|---|
| | | | GQPENNYKTTPPVLDSDGSFFLYSKLTVD KSRWQQGNVFSCSVMHEALHNHYTQKSLS LSPG |
| 491 | 2382F03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAD AYGYYRITYGETGGNSPVQEFTVPVSKGT ATISGLKPGVDYTITVYAVEFNFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 492 | 2382F05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEA GKHYGYYRITYGETGGNSPVQEFTVPVSK GTATISGLKPGVDYTITVYAVEFDFPGAG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 493 | 2382F08-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEA YGYYRITYGETGGNSPVQEFTVPVSKGTA TISGLKPGVDYTITVYAVEFTYPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 494 | 2382F09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAA YGYYRITYGETGGNSPVQEFTVPVSKGTA TISGLKPGVDYTITVYAVEYDFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 495 | 2382G04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG GYGYYRITYGETGGNSPVQEFTVPSSKGT ATISGLKPGVDYTITVYAVEFDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 496 | 2382H10-Fc fusion | X1 is optional and when present can be selected from E, EI, EID, EIDK (SEQ ID NO: 384), EIE, and EIEK (SEQ ID NO: 635); X2 is selected from hinge sequences | GVSDVPRDLEVVAATPTSLLISWDAPAGG YGYYRITYGETGGNSPVQEFTVPVSKGTA TISGLKPGVDYTITVYAVEFDFPGSGYYH RPISINYRT-$X_1$-$X_2$- VFLFPPKPKDTLMISRTPEVTCVVVDVSH EDPEVKFNWYVDGVEVHNAKTKPREEQYN |

TABLE 1-continued

Exemplary Anti-PCSK9 Adnectin-Fc Fusion Proteins

| SEQ ID Name | Clone or Description | Sequence |
|---|---|---|
| | sequences SEQ ID NOs: 317-321; the Fc may optionally include a C-terminal K | STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 497 | 2382H11-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG YGYYRITYGETGGNSPVQEFTVPVFKGTA TISGLKPGVDYTITVYAVEFDYPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 498 | 2382H04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAG GYGYYRITYGETGGNSPVQEFTVPSSKGT ATISGLKPGVDYTITVYAVEYDFPGAGYY HRPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 499 | 2382H07-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADA YGYYRITYGETGGNSPVQEFTVPSKGTA TISGLKPGVDYTITVYAVEFDFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 500 | 2382H09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAA YGYYRITYGETGGNSPVQEFTVPSSKGTA TISGLKPGVDYTITVYAVEFDFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 501 | 2451A02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAG YGYYRITYGETGGNSPVQEFTVPVSKGTA TISGLKPGVDYTITVYAVEFPFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |

TABLE 1-continued

Exemplary Anti-PCSK9 Adnectin-Fc Fusion Proteins

| SEQ ID Clone or Name | Description | Sequence |
|---|---|---|
| 502 2451B05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG YGYYRITYGETGGNSPVQEFTVPSSKGTA TISGLKPGVDYTITVYAVEFDYPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 503 2451B06-Fc fusion (equivalent to 2382D05) | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADG GYGYYRITYGETGGNSPVQEFTVPVSKGT ATISGLKPGVDYTITVYAVEFDFPGAGYY HRPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 504 2451C06-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGA ASYGYYRITYGETGGNSPVQEFTVPVSKG TATISGLKPGVDYTITVYAVEFPFPGAGY YHRPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 505 2451D05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGA YGYYRITYGETGGNSPVQEFTVPVSKGTA TISGLKPGVDYTITVYAVEFDFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 506 2451F03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDPPAEG YGYYRITYGETGGNSPVQEFTVPVSKGTA TISGLKPGVDYTITVYAVEFNFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 507 2451G01-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG YGYYRITYGETGGNSPVQEFTVPSSKGTA TISGLKPGVDYTITVYAVEFDFPGSGYYH RPISINYRT-X$_1$-X$_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN |

TABLE 1-continued

Exemplary Anti-PCSK9 Adnectin-Fc Fusion Proteins

| SEQ ID Clone or Name | Description | Sequence |
|---|---|---|
| | | GQPENNYKTTPPVLDSDGSFFLYSKLTVD KSRWQQGNVFSCSVMHEALHNHYTQKSLS LSPG |
| 508 2451H07-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GITDVPRDLEVVAATPTSLLISWNPPDVN YGYYRITYGETGGNSPLQEFTVPVSKGTA TISGLKPGVDYTITVYAVEYPYAHAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 509 2382E03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGD GYGYYRITYGETGGNSPVQEFTVPVSKGT ATISGLKPGVDYTITVYAVEFDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 510 2382E04-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG GYGYYRITYGETGGNSPVQEFTVPVSKGT ATISGLKPGVDYTITVYAVEFTFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 511 2382E05-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEG GYGYYRITYGETGGNSPVQEFTVPVSKGT ATISGLKPGVDYTITVYAVEFDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 512 2382E09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEA YGYYRITYGETGGNSPVQEFTVPVSKGTA TISGLKPGVDYTITVYAVEYDFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 513 2381A04-Fc fusion | X1 is optional and when present can be selected from E, EI, EID, EIDK (SEQ ID NO: 384), EIE, and EIEK (SEQ ID NO: 635); X2 is selected from hinge | GVSDVPRDLEVVAATPTSLLISWEPFSRL PGGGEYYRITYGETGGNSPLQQFTVPGSK GTATISGLKPGVDYTITVYAVEYPYPFSG YYHRPISINYRT-$X_1$-$X_2$- VFLFPPKPKDTLMISRTPEVTCVVVDVSH EDPEVKFNWYVDGVEVHNAKTKPREEQYN |

TABLE 1-continued

Exemplary Anti-PCSK9 Adnectin-Fc Fusion Proteins

| SEQ ID | Clone or Name | Description | Sequence |
|---|---|---|---|
| | | sequences SEQ ID NOs: 317-321; the Fc may optionally include a C-terminal K | STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 514 | 2381A08-Fc fusion | $X_1$ is optional and when present can be selected from E, EI, EID, EIDK (SEQ ID NO: 384), EIE, and EIEK (SEQ ID NO: 635); $X_2$ is selected from hinge sequences SEQ ID NOs: 317-321; the Fc may optionally include a C-terminal K | GVSDVPRDLEVVAATPTSLLISWDAPADG GYGYYRITYGETGGNSPVQEFTVPGSKGT ATISGLKPGVDYTITVYAVEYDFPGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 515 | 2381B10-Fc fusion | $X_1$ is optional and when present can be selected from E, EI, EID, EIDK (SEQ ID NO: 384), EIE, and EIEK (SEQ ID NO: 635); $X_2$ is selected from hinge sequences SEQ ID NOs: 317-321; the Fc may optionally include a C-terminal K | GVSDVPRDLEVVAATPTSLLISWDAPAGG GYGYYRITYGETGGNSPVQEFTVPVSKGT ATISGLKPGVDYTITVYAVEYNFIGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 516 | 2381C08-Fc fusion | $X_1$ is optional and when present can be selected from E, EI, EID, EIDK (SEQ ID NO: 384), EIE, and EIEK (SEQ ID NO: 635); $X_2$ is selected from hinge sequences SEQ ID NOs: 317-321; the Fc may optionally include a C-terminal K | GVSDVPRDLEVVAATPTSLLISWDAPADG AYGYYRITYGETGGNSPVQEFTVPVSKGT ATISGLKPGVDYTITVYAVEFPYPFAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 517 | 2381G06-Fc fusion | $X_1$ is optional and when present can be selected from E, EI, EID, EIDK (SEQ ID NO: 384), EIE, and EIEK (SEQ ID NO: 635); $X_2$ is selected from hinge sequences SEQ ID NOs: 317-321; the Fc may optionally include a C-terminal K | GVSDVPRDLEVVAATPTSLLISWSEKLDG KARRGYYRITYGETGGNSPVQQFTVPGSK GTATISGLKPGVDYTITVYAVEFPYDHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 518 | 2381H01-Fc fusion | $X_1$ is optional and when present can be selected from E, EI, EID, EIDK (SEQ ID NO: 384), EIE, and EIEK (SEQ ID NO: 635); $X_2$ is selected from hinge sequences SEQ ID NOs: 317-321; the Fc may optionally include a C-terminal K | GVSDVPRDLEVVAATPTSLLISWSPRDST GLVRRGYYRITYGETGGNSPVQQFTVPGS KGTATISGLKPGVDYTITVYAVEYPYDHS GYYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |

TABLE 1-continued

Exemplary Anti-PCSK9 Adnectin-Fc Fusion Proteins

| SEQ ID | Clone or Name | Description | Sequence |
|---|---|---|---|
| 519 | 2381H06-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWGDVRTN EARQGYYRITYGETGNSPLQGFTVPGSK GTATISGLKPGVDYTITVYAVEYTYEHSG YYHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 520 | 2381H09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG GYGYYRITYGETGGNSPVQEFTVPSKGT ATISGLKPGVDYTITVYAVEFDFVGAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 521 | 2382B11-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAA YGYYRITYGETGGNSPVQEFTVPSKGTA TISGLKPGVDYTITVYAVEYDFAGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 522 | 2382B08-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADA YGYYRITYGETGGNSPVQEFTVPSSKGTA TISGLKPGVDYTITVYAVEFAFPGAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 523 | 2382C11-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAGG YGYYRITYGETGGNSPVQEFTVPSKGTA TISGLKPGVDYTITVYAVEYDFAGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 524 | 2382G03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEA EAYGYYRITYGETGGNSPVQEFTVPSKG TATISGLKPGVDYTITVYAVEYVFPGAGY YHRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN |

TABLE 1-continued

Exemplary Anti-PCSK9 Adnectin-Fc Fusion Proteins

| SEQ ID NO | Clone or Name | Description | Sequence |
|---|---|---|---|
| | | | GQPENNYKTTPPVLDSDGSFFLYSKLTVD KSRWQQGNVFSCSVMHEALHNHYTQKSLS LSPG |
| 525 | 2382H03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAEG AYGYYRITYGETGGNSPVQEFTVPVSKGT ATISGLKPGVDYTITVYAVEYPYPFAGYY HRPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 526 | 2451A10-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVTDVPRDMEVVAATPTSLLISWQPPAVT YGYYRITYGETGGNSTLQQFTVPVYKGTA TISGLKPGVDYTITVYAVEYPYDHSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 527 | 2451B02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAA YGYYRITYGETGGNSPVQEFTVPVSKGTA TISGLKPGVDYTITVYAVEFDYPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 528 | 2451C11-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GIVDVPRDLEVVAATPTSLLISWDPPAGA YGYYRITYGETGGNSPKQQFTVPGYKGTA TISGLKPGVDYTITVYAVEYPYDHSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPGK |
| 529 | 2451H01-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPAAG YGYYRITYGETGGNSPVQEFTVPVSKGTA TISGLKPGVDYTITVYAVEYDFPGSGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 530 | 2011B11-Fc fusion | X1 is optional and when present can be selected from E, EI, EID, EIDK (SEQ ID NO: 384), EIE, and EIEK (SEQ ID NO: 635); X2 is selected from hinge | GVSDVPRDLEVVAATPTSLLISWAPPSDA YGYYRITYGETGGNSPVQEFTVPIGKGTA TISGLKPGVDYTITVYAVEYPYSHAGYYH RPISINYRT-$X_1$-$X_2$- VFLFPPKPKDTLMISRTPEVTCVVVDVSH EDPEVKFNWYVDGVEVHNAKTKPREEQYN |

TABLE 1-continued

Exemplary Anti-PCSK9 Adnectin-Fc Fusion Proteins

| SEQ ID | Clone or Name | Description | Sequence |
|---|---|---|---|
| | | sequences SEQ ID NOs: 317-321; the Fc may optionally include a C-terminal K | STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 531 | 2971A03-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDPPSDD YGYYRITYGETGGNSPVQEFTVPIGKGTA TISGLKPGVDYTITVYAVEFPWPHAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 532 | 2971A09-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPADD YGYYRITYGETGGNSPVQEFTVPIGKGTA TISGLKPGVDYTITVYAVEFPWPHAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| 533 | 2971E02-Fc fusion | X1 is optional and when present can be selected from E, EI, EID, EIDK (SEQ ID NO: 384), EIE, and EIEK (SEQ ID NO: 635); X2 is selected from hinge sequences SEQ ID NOs: 317-321; the Fc may optionally include a C-terminal K | GVSDVPRDLEVVAATPTSLLISWDAPSDD YGYYRITYGETGGNSPVQEFTVPIGKGTA TISGLKPGVDYTITVYAVEFPWPHAGYYH RPISINYRT-$X_1$-$X_2$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG |
| | | $X_1$-Fc-$X_2$-PCSK9 Adnectin N-Terminal Fusions | |
| 534 | Fc-1459D05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWPPPSHGY GYYRITYGETGGNSPVQEFTVPPGKGTAT ISGLKPGVDYTITVYAVEYPYKHSGYYHR PISINYRT-$X_3$ |
| 535 | Fc-1784F03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWRPPIHAY GYYRITYGETGGNSPVQEFTVPIVEGTAT ISGLKPGVDYTITVYAVEYTFKHSGYYHR PISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 536 | Fc-1784F03-m1 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPAHAYGYYRITYGETGGNSPVQEFTVPGSEGTATISGLKPGVDYTITVYAVEYTFKHSGYYHRPISINYRT-$X_3$ |
| 537 | Fc-1784F03-m2 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPAHAYGYYRITYGETGGNSPVQEFTVPGSKGTATISGLKPGVDYTITVYAVEYTFKHSGYYHRPISINYRT-$X_3$ |
| 538 | Fc-1784F03-m3 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPAVTYGYYRITYGETGGNSPVQEFTVPGSKSTATISGLKPGVDYTITVYAVEYTFKHSGYYHRPISINYRT-$X_3$ |
| 539 | Fc-1813E02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWSPPANGYGYYRITYGETGGNSPVQEFTVPVGRGTATISGLKPGVDYTITVYAVEYTYKGSYYHRPISINYRT-$X_3$ |
| 540 | Fc-1923B02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWTPPPKGYGYYRITYGETGGNSPVQEFTVPVGEGTATISGLKPGVDYTITVYAVEYTYNGAGYYHRPISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 541 | Fc-1923B02(N82I) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWTPPPKGY GYYRITYGETGGNSPVQEFTVPVGEGTAT ISGLKPGVDYTITVYAVEYTYIGAGYYHR PISINYRT-$X_3$ |
| 542 | Fc-1923B02(N82E) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWTPPPKGY GYYRITYGETGGNSPVQEFTVPVGEGTAT ISGLKPGVDYTITVYAVEYTYEGAGYYHR PISINYRT-$X_3$ |
| 543 | Fc-1923B02(T80A) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWTPPPKGY GYYRITYGETGGNSPVQEFTVPVGEGTAT ISGLKPGVDYTITVYAVEYAYNGAGYYHR PISINYRT-$X_3$ |
| 544 | Fc-1922G04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWRPPSHAY GYYRITYGETGGNSPVQEFTVPIGKGTAT ISGLKPGVDYTITVYAVEYPWKGSGYYHR PISINYRT-$X_3$ |
| 545 | Fc-1922G04(R25D) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDPPSHAY GYYRITYGETGGNSPVQEFTVPIGKGTAT ISGLKPGVDYTITVYAVEYPWKGSGYYHR PISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 546 | Fc-1922G04(R25E) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWEPPSHAY GYYRITYGETGGNSPVQEFTVPIGKGTAT ISGLKPGVDYTITVYAVEYPWKGSGYYHR PISINYRT-X$_3$ |
| 547 | Fc-1922G04(R25S) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWSPPSHAY GYYRITYGETGGNSPVQEFTVPIGKGTAT ISGLKPGVDYTITVYAVEYPWKGSGYYHR PISINYRT-X$_3$ |
| 548 | Fc-2012A04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWRPPSNGH GYYRITYGETGGNSPVQEFTVPVNEGTAT ISGLKPGVDYTITVYAVEFPFKWSGYYHR PISINYRT-X$_3$ |
| 549 | Fc-2013E01 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWVPPSDDY GYYRITYGETGGNSPVQEFTVPIGKGTAT ISGLKPGVDYTITVYAVEFPWPHAGYYHR PISINYRT-X$_3$ |
| 550 | Fc-2011H05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWVPSSHAY GYYRITYGETGGNSPVQEFTVPVGVGTAT ISGLKPGVDYTITVYAVEYAFEGAGYYHR PISINYRT-X$_3$ |
| 551 | Fc-2011H05(V23D) fusion | X1 is selected from hinge sequences SEQ ID NOs: 317-321; X2 is selected from linker sequences SEQ ID | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK |

TABLE 1-continued

Exemplary Anti-PCSK9 Adnectin-Fc Fusion Proteins

| SEQ ID NO | Clone or Name | Description | Sequence |
|---|---|---|---|
| | | NOs: 310-314 and 620-634; X3 is optional and when present can be a C-terminal tail sequence selected from SEQ ID NOs: 380-395 and EIEK (SEQ ID NO: 635) | ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDPSSHAY GYYRITYGETGGNSPVQEFTVPVGVGTAT ISGLKPGVDYTITVYAVEYAFEGAGYYHR PISINYRT-X3 |
| 552 | Fc-2011H05(V23E) fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWEPSSHAY GYYRITYGETGGNSPVQEFTVPVGVGTAT ISGLKPGVDYTITVYAVEYAFEGAGYYHR PISINYRT-X3 |
| 553 | Fc-2381B02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWEPFSRLP GGGEYYRITYGETGGNSPLQQFTVPGSKG TATISGLKPGVDYTITVYAVEYPYDYSGY YHRPISINYRT-X3 |
| 554 | Fc-2381B04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWEPFSRLP GGGEYYRITYGETGGNSPLQQFTVPGSKG TATISGLKPGVDYTITVYAVEYPYEHSGY YHRPISINYRT-X3 |
| 555 | Fc-2381B06 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWEPFSRLP GGGEYYRITYGETGGNSPLQQFTVPGSKG TATISGLKPGVDYTITVYAVEYPYPHSGY YHRPISINYRT-X3 |
| 556 | Fc-2381B08 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- |

TABLE 1-continued

Exemplary Anti-PCSK9 Adnectin-Fc Fusion Proteins

| SEQ ID | Clone or Name | Description | Sequence |
|---|---|---|---|
| | | EIEK (SEQ ID NO: 635) | VSDVPRDLEVVAATPTSLLISWDAPADGG YGYYRITYGETGGNSPVQEFTVPSSKGTA TISGLKPGVDYTITVYAVEYTFPGAGYYH RPISINYRT-$X_3$ |
| 557 | Fc-2381D02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWEPFSRLP GGGEYYRITYGETGGNSPLQQFTVPGSKG TATISGLKPGVDYTITVYAVEYPYDHSGY YHRPISINYRT-$X_3$ |
| 558 | Fc-2381D04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWEPFSRLP GGGEYYRITYGETGGNSPLQQFTVPGSKG TATISGLKPGVDYTITVYAVEFPYDHSGY YHRPISINYRT-$X_3$ |
| 559 | Fc-2381F11 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWDAPADGG YGYYRITYGETGGNSPVQEFTVPVSKSTA TISGLKPGVDYTITVYAVEYTFPGAGYYH RPISINYRT-$X_3$ |
| 560 | Fc-2381G03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWEPFSRLP GGGEYYRITYGETGGNSPLQQFTVPGSKG TATISGLKPGVDYTITVYAVEFPYAHSGY YHRPISINYRT-$X_3$ |
| 561 | Fc-2381G09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$- VSDVPRDLEVVAATPTSLLISWDAPAGDG YGYYRITYGETGGNSPVQEFTVPVSKGTA TISGLKPGVDYTITVYAVEFTFPGAGYYH RPISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 562 | Fc-2381H03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWEPFSRLP GGGEYYRITYGETGGNSPLQQFTVPGSKG TATISGLKPGVDYTITVYAVEYPYAHSGY FHRPISINYRT-X$_3$ |
| 563 | Fc-2382A01 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWAAPAGGG YGYYRITYGETGGNSPVQEFTVPVSKGTA TISGLKPGVDYTITVYAVEYDFPGAGYYH RPISINYRT-X$_3$ |
| 564 | Fc-2382B10 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPADAY GYYRITYGETGGNSPVQEFTVPSSKGTAT ISGLKPGVDYTITVYAVEYDFPGSGYYHR PISINYRT-X$_3$ |
| 565 | Fc-2382B09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPADAY GYYRITYGETGGNSPVQEFTVPVSKGTAT ISGLKPGVDYTITVYAVEFDYPGSGYYHR PISINYRT-X$_3$ |
| 566 | Fc-2382C05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPADGA YGYYRITYGETGGNSPVQEFTVPVSKGTA TISGLKPGVDYTITVYAVEYSFPGAGYYH RPISINYRT-X$_3$ |
| 567 | Fc-2382C09 fusion | X1 is selected from hinge sequences SEQ ID NOs: 317-321; X2 is selected from linker sequences SEQ ID NOs: 310-314 and 620-634; | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR |

TABLE 1-continued

Exemplary Anti-PCSK9 Adnectin-Fc Fusion Proteins

| SEQ ID NO: | Clone or Name | Description | Sequence |
|---|---|---|---|
| | | X3 is optional and when present can be a C-terminal tail sequence selected from SEQ ID NOs: 380-395 and EIEK (SEQ ID NO: 635) | DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPAEGY GYYRITYGETGGNSPVQEFTVPVSKGTAT ISGLKPGVDYTITVYAVEFDFPGSGYYHR PISINYRT-X3 |
| 568 | Fc-2382D03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPADEA YGYYRITYGETGGNSPVQEFTVPVSKGTA TISGLKPGVDYTITVYAVEFDFPGAGYYH RPISINYRT-X3 |
| 569 | Fc-2382D05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPADGG YGYYRITYGETGGNSPVQEFTVPVSKGTA TISGLKPGVDYTITVYAVEFDFPGAGYYH RPISINYRT-X3 |
| 570 | Fc-2382D08 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPADGY GYYRITYGETGGNSPVQEFTVPVSKGTAT ISGLKPGVDYTITVYAVEFPFPGSGYYHR PISINYRT-X3 |
| 571 | Fc-2382D09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPAEGY GYYRITYGETGGNSPVQEFTVPVSKGTAT ISGLKPGVDYTITVYAVEFDFPGAGYYHR PISINYRT-X3 |
| 572 | Fc-2382F02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1- VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2- VSDVPRDLEVVAATPTSLLISWDAPAGGG |

TABLE 1-continued

Exemplary Anti-PCSK9 Adnectin-Fc Fusion Proteins

| SEQ ID | Clone or Name | Description | Sequence |
|---|---|---|---|
| | | | YGYYRITYGETGGNSPVQEFTVPVSKGTA TISGLKPGVDYTITVYAVEFDFPGSGYYH RPISINYRT-X$_3$ |
| 573 | Fc-2382F03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAADA YGYYRITYGETGGNSPVQEFTVPVSKGTA TISGLKPGVDYTITVYAVEFNFPGAGYYH RPISINYRT-X$_3$ |
| 574 | Fc-2382F05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAEAG KHYGYYRITYGETGGNSPVQEFTVPVSKG TATISGLKPGVDYTITVYAVEFDFPGAGY YHRPISINYRT-X$_3$ |
| 575 | Fc-2382F08 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAEAY GYYRITYGETGGNSPVQEFTVPVSKGTAT ISGLKPGVDYTITVYAVEFTYPGSGYYHR PISINYRT-X$_3$ |
| 576 | Fc-2382F09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAAAY GYYRITYGETGGNSPVQEFTVPVSKGTAT ISGLKPGVDYTITVYAVEYDFPGSGYYHR PISINYRT-X$_3$ |
| 577 | Fc-2382G04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAGGG YGYYRITYGETGGNSPVQEFTVPSSKGTA TISGLKPGVDYTITVYAVEFDFPGAGYYH RPISINYRT-X$_3$ |

TABLE 1-continued

Exemplary Anti-PCSK9 Adnectin-Fc Fusion Proteins

| SEQ ID | Clone or Name | Description | Sequence |
|---|---|---|---|
| 578 | Fc-2382H10 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGGY GYYRITYGETGGNSPVQEFTVPVSKGTAT ISGLKPGVDYTITVYAVEFDFPGSGYYHR PISINYRT-$X_3$ |
| 579 | Fc-2382H11 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPADGY GYYRITYGETGGNSPVQEFTVPVFKGTAT ISGLKPGVDYTITVYAVEFDYPGSGYYHR PISINYRT-$X_3$ |
| 580 | Fc-2382H04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAAGG YGYYRITYGETGGNSPVQEFTVPSSKGTA TISGLKPGVDYTITVYAVEYDFPGAGYYH RPISINYRT-$X_3$ |
| 581 | Fc-2382H07 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPADAY GYYRITYGETGGNSPVQEFTVPGSKGTAT ISGLKPGVDYTITVYAVEFDFPGSGYYHR PISINYRT-$X_3$ |
| 582 | Fc-2382H09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAAAY GYYRITYGETGGNSPVQEFTVPSSKGTAT ISGLKPGVDYTITVYAVEFDFPGSYYHR PISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 583 | Fc-2451A02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAAGY GYYRITYGETGGNSPVQEFTVPVSKGTAT ISGLKPGVDYTITVYAVEFPFPGSGYYHR PISINYRT-$X_3$ |
| 584 | Fc-2451B05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGGY GYYRITYGETGGNSPVQEFTVPSSKGTAT ISGLKPGVDYTITVYAVEFDYPGSGYYHR PISINYRT-$X_3$ |
| 585 | Fc-2451B06 fusion (equivalent to 2382D05) | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPADGG YGYYRITYGETGGNSPVQEFTVPVSKGTA TISGLKPGVDYTITVYAVEFDFPGAGYYH RPISINYRT-$X_3$ |
| 586 | Fc-2451C06 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGAA SYGYYRITYGETGGNSPVQEFTVPVSKGT ATISGLKPGVDYTITVYAVEFPFPGAGYY HRPISINYRT-$X_3$ |
| 587 | Fc-2451D05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGAY GYYRITYGETGGNSPVQEFTVPVSKGTAT ISGLKPGVDYTITVYAVEFDFPGSYYHR PISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 588 | Fc-2451F03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDPPAEGY GYYRITYGETGGNSPVQEFTVPSSKGTAT ISGLKPGVDYTITVYAVEFNFPGSGYYHR PISINYRT-X$_3$ |
| 589 | Fc-2451G01 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAGGY GYYRITYGETGGNSPVQEFTVPSSKGTAT ISGLKPGVDYTITVYAVEFDFPGSGYYHR PISINYRT-X$_3$ |
| 590 | Fc-2451H07 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-ITDVPRDLEVVAATPTSLLISWNPPDVNY GYYRITYGETGGNSPLQEFTVPVSKGTAT ISGLKPGVDYTITVYAVEYPYAHAGYYHR PISINYRT-X$_3$ |
| 591 | Fc-2382E03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAGDG YGYYRITYGETGGNSPVQEFTVPVSKGTA TISGLKPGVDYTITVYAVEFDFPGAGYYH RPISINYRT-X$_3$ |
| 592 | Fc-2382E04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X$_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X$_2$-VSDVPRDLEVVAATPTSLLISWDAPAGGG YGYYRITYGETGGNSPVQEFTVPVSKGTA TISGLKPGVDYTITVYAVEFDFPGAGYYH RPISINYRT-X$_3$ |

TABLE 1-continued

Exemplary Anti-PCSK9 Adnectin-Fc Fusion Proteins

| SEQ ID | Clone or Name | Description | Sequence |
|---|---|---|---|
| 593 | Fc-2382E05 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAEGG YGYYRITYGETGGNSPVQEFTVPVSKGTA TISGLKPGVDYTITVYAVEFDFPGAGYYH RPISINYRT-$X_3$ |
| 594 | Fc-2382E09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAEAY GYYRITYGETGGNSPVQEFTVPVSKGTAT ISGLKPGVDYTITVYAVEYDFPGSGYYHR PISINYRT-$X_3$ |
| 595 | Fc-2381A04 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWEPFSRLP GGGEYYRITYGETGGNSPLQQFTVPGSKG TATISGLKPGVDYTITVYAVEYPYPFSGY YHRPISINYRT-$X_3$ |
| 596 | Fc-2381A08 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPADGG YGYYRITYGETGGNSPVQEFTVPGSKGTA TISGLKPGVDYTITVYAVEYDFPGAGYYH RPISINYRT-$X_3$ |
| 597 | Fc-2381B10 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGGG YGYYRITYGETGGNSPVQEFTVPVSKGTA TISGLKPGVDYTITVYAVEYNFIGAGYYH RPISINYRT-$X_3$ |

TABLE 1-continued

Exemplary Anti-PCSK9 Adnectin-Fc Fusion Proteins

| SEQ ID Name | Clone or Description | Sequence |
|---|---|---|
| 598Fc-2381C08 Fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPADGA YGYYRITYGETGGNSPVQEFTVPVSKGTA TISGLKPGVDYTITVYAVEFPYPFAGYYH RPISINYRT-$X_3$ |
| 599Fc-2381G06 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWSEKLDGK ARRGYYRITYGETGGNSPVQQFTVPGSKG TATISGLKPGVDYTITVYAVEFPYDHSGY YHRPISINYRT-$X_3$ |
| 600Fc-2381H01 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWSPRDSTG LVRRGYYRITYGETGGNSPVQQFTVPGSK GTATISGLKPGVDYTITVYAVEYPYDHSG YYHRPISINYRT-$X_3$ |
| 601Fc-2381H06 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWGDVRTNE ARQGYYRITYGETGGNSPLQGFTVPGSKG TATISGLKPGVDYTITVYAVEYTYEHSGY YHRPISINYRT-$X_3$ |
| 602Fc-2381H09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-$X_2$-VSDVPRDLEVVAATPTSLLISWDAPAGGG YGYYRITYGETGGNSPVQEFTVPVSKGTA TISGLKPGVDYTITVYAVEFDFVGAGYYH RPISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 603 | Fc-2382B11 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDAPAAAY GYYRITYGETGGNSPVQEFTVPVSKGTAT ISGLKPGVDYTITVYAVEYDFAGSGYYHR PISINYRT-X3 |
| 604 | Fc-2382B08 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDAPADAY GYYRITYGETGGNSPVQEFTVPSSKGTAT ISGLKPGVDYTITVYAVEFAFPGAGYYHR PISINYRT-X3 |
| 605 | Fc-2382C11 Fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDAPAGGY GYYRITYGETGGNSPVQEFTVPVSKGTAT ISGLKPGVDYTITVYAVEYDFAGSGYYHR PISINYRT-X3 |
| 606 | Fc-2382G03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDAPAEAE AYGYYRITYGETGGNSPVQEFTVPVSKGT ATISGLKPGVDYTITVYAVEYVFPGAGYY HRPISINYRT-X3 |
| 607 | Fc-2382H03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | X1-VFLFPPKPKDTLMISRTPEVTCVVVDVSH EDPEVKFNWYVDGVEVHNAKTKPREEQYN STYRVVSVLTVLHQDWLNGKEYKCKVSNK ALPAPIEKTISKAKGQPREPQVYTLPPSR DELTKNQVSLTCLVKGFYPSDIAVEWESN GQPENNYKTTPPVLDSDGSFFLYSKLTVD KSRWQQGNVFSCSVMHEALHNHYTQKSLS LSPG-X2-VSDVPRDLEVVAATPTSLLISWDAPAEGA YGYYRITYGETGGNSPVQEFTVPVSKGTA TISGLKPGVDYTITVYAVEYPYPFAGYYH RPISINYRT-X3 |

TABLE 1-continued

Exemplary Anti-PCSK9 Adnectin-Fc Fusion Proteins

| SEQ ID | Clone or Name | Description | Sequence |
|---|---|---|---|
| 608 | Fc-2451A10 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VTDVPRDMEVVAATPTSLLISWQPPAVTYGYYRITYGETGGNSTLQQFTVPVYKGTATISGLKPGVDYTITVYAVEYPYDHSGYYHRPISINYRT-$X_3$ |
| 609 | Fc-2451B02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPAAAYGYYRITYGETGGNSPVQEFTVPVSKGTATISGLKPGVDYTITVYAVEFDYPGSGYYHRPISINYRT-$X_3$ |
| 610 | Fc-2451C11 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-IVDVPRDLEVVAATPTSLLISWDPPAGAYGYYRITYGETGGNSPKQQFTVPGYKGTATISGLKPGVDYTITVYAVEYPYDHSGYYHRPISINYRT-$X_3$ |
| 611 | Fc-2451H01 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPAAGYGYYRITYGETGGNSPVQEFTVPVSKGTATISGLKPGVDYTITVYAVEYDFPGSGYYHRPISINYRT-$X_3$ |
| 612 | Fc-2011B11 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWAPPSDAYGYYRITYGETGGNSPVQEFTVPIGKGTATISGLKPGVDYTITVYAVEYPYSHAGYYHRPISINYRT-$X_3$ |

TABLE 1-continued

Exemplary Anti-PCSK9 Adnectin-Fc Fusion Proteins

| SEQ ID | Clone or Name | Description | Sequence |
|---|---|---|---|
| 613 | Fc-2971A03 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDPPSDDYGYYRITYGETGGNSPVQEFTVPIGKGTATISGLKPGVDYTITVYAVEFPWPHAGYYHRPISINYRT-$X_3$ |
| 614 | Fc-2971A09 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPADDYGYYRITYGETGGNSPVQEFTVPIGKGTATISGLKPGVDYTITVYAVEFPWPHAGYYHRPISINYRT-$X_3$ |
| 615 | Fc-2971E02 fusion | X1 is selected from hinge sequences SEQ ID NOs: 317-321; X2 is selected from linker sequences SEQ ID NOs: 310-314 and 620-634; X3 is optional and when present can be a C-terminal tail sequence selected from SEQ ID NOs: 380-395 and EIEK (SEQ ID NO: 635) | $X_1$-VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG-$X_2$-VSDVPRDLEVVAATPTSLLISWDAPSDDYGYYRITYGETGGNSPVQEFTVPIGKGTATISGLKPGVDYTITVYAVEFPWPHAGYYHRPISINYRT-$X_3$ |

In some embodiments, the anti-PCSK9 Adnectin comprises an Fn3 domain and a PK moiety. In some embodiments, the Fn3 domain is a $^{10}$Fn3 domain. In some embodiments, the PK moiety increases the serum half-life of the polypeptide by more than 5, 10, 20, 30, 40, 50, 60, 70, 80, 90, 100, 120, 150, 200, 400, 600, 800, 1000% or more relative to the Fn3 domain alone.

In some embodiments, the PK moiety is a polymeric sugar. In some embodiments, the PK moiety is a polyethylene glycol moiety. In some embodiments the PK moiety is a serum albumin binding protein. In some embodiments the PK moiety is human serum albumin. In some embodiments the PK moiety is a serum immunoglobulin binding protein. In some embodiments, the PK moiety is transferrin.

In some embodiments the PK moiety is another Adnectin specific for a serum protein, e.g., HSA. The present application provides specific serum albumin binding Adnectin molecules (or SABA), as described herein. In certain embodiments, a PCSK9 Adnectin fused to a SABA can be defined generally as follows: $X_1$-PCSK9 Adnectin core-$X_2$-$X_3$-$X_4$-SABA core-$X_5$ (SEQ ID NO: 618), or $X_1$-SABA core-$X_2$-$X_3$-$X_4$-PCSK9 Adnectin core-$X_5$ (SEQ ID NO: 619), wherein $X_1$ and $X_4$ represent optional N-terminal extension sequences, $X_2$ and $X_5$ represent optional C-terminal extension sequences, and $X_3$ is a linker. In one embodiment, the Adnectins (either PCSK9 or serum albumin binding) of SEQ ID NOs: 618 and 619 comprise the "core" region of Adnectin, i.e., a PCSK9 Adnectin core sequence may be any one of the PCSK9 Adnectin sequences shown in Table 4, wherein the sequence begins at the amino acid residue corresponding to E8 of SEQ ID NO:1 and ends at the amino acid corresponding to residue T94 of SEQ ID NO:1; and a SABA core sequence may be selected from any of the SABA core sequences shown in Table 6.

In some embodiments, $X_1$ and $X_4$ are independently optional, and when present are independently selected from SEQ ID NOs: 371-379 listed in Table 6, and may optionally comprise an M, G or MG sequence at the N-terminus when such residues are not already present. For expression in a mammalian system, the fusion proteins may further comprise a leader sequence at the N-terminus, such as METDTLLL-WVLLLWVPGSTG (SEQ ID NO: 326). In some embodiments, $X_2$ and $X_5$ are independently optional, and when present are independently selected from SEQ ID NOs: 380-395 listed in Table 6. In certain embodiments, $X_3$ is a linker sequence selected from SEQ ID NOs: 396-419 listed in Table 6. The sequences shown in Table 2 represent exemplary fusions of anti-PCSK9 Adnectin and SABA. It should be understood that any PCSK9 Adnectin and SABA sequence described in the present application may be incorporated into these configurations.

TABLE 2

Exemplary PCSK9 Adnectin - SABA Fusion Sequences

| SEQ ID | Clone or Name | Description | Sequence |
|---|---|---|---|
| 616 | PCSK9 Adnectin-SABA fusion | PCSK9 Adnectin sequence is underlined; SABA sequence is in bold. PCSK9 Adnectin sequence is the core region derived from clone 2013E01, SABA sequence is derived from SABA 1 (SEQ ID NO: 330) | $X_1$-EVVAATPTSLLISWVPPSDDYGYYRITY GETGGNSPVQEFTVPIGKGTATISGLKP GVDYTITVYAVEFPWPHAGYYHRPISIN YRT-$X_2$-$X_3$-$X_4$-EVVAATPTSLLISWHSYYEQNSYYRITY GETGGNSPVQEFTVPYSQTTATISGLKP GVDYTITVYAVYGSKYYYPIS INYRT-$X_5$ |
| 617 | SABA-PCSK9 Adnectin fusion | SABA sequence is in bold; PCSK9 Adnectin sequence is underlined. SABA sequence is derived from SABA 1 (SEQ ID NO: 330); PCSK9 Adnectin sequence is the core region derived from clone 2013E01 | $X_1$-EVVAATPTSLLISWHSYYEQNSYYRITY GETGGNSPVQEFTVPYSQTTATISGLKP GVDYTITVYAVYGSKYYYPIS INYRT-$X_2$-$X_3$-$X_4$-EVVAATPTSLLISWVPPSDDYGYYRITY GETGGNSPVQEFTVPIGKGTATISGLKP GVDYTITVYAVEFPWPHAGYYHRPISIN YRT-$X_5$ |

Biophysical and Biochemical Characterization

The application provides Adnectin comprising a Fn3 domain that binds to PCSK9. Polypeptide binding to a target molecule may be assessed in terms of equilibrium constants (e.g., dissociation, $K_D$) and in terms of kinetic constants (e.g., on-rate constant, $K_{on}$ and off-rate constant, $k_{off}$). An Adnectin will generally bind to a target molecule with a $K_D$ of less than 500 nM, 100 nM, 10 nM, 1 nM, 500 pM, 200 pM, 100 pM, although higher $K_D$ values may be tolerated where the $K_{off}$ is sufficiently low or the $K_{on}$, is sufficiently high.

The SEQ ID NOS of the BC, DE and FG loops of the anti-PCSK9 Adnectins of the invention are presented in Table 3.

TABLE 3

Anti-PCSK9 Adnectin BC, DE and FG Loops

| Clone ID | Affinity $K_D$, nM | PCSK9-EGFA FRET ($EC_{50}$, nM) | LDLR Depletion (% inhibition at 75 nM, $EC_{50}$ (nM)) | BC Loop | SEQ ID NO | DE Loop | SEQ ID NO | FG loop | SEQ ID NO: |
|---|---|---|---|---|---|---|---|---|---|
| 1459D05 | 14.41†<br>1.58*<br>26^ | 4 | 66.8, >200 | SWPPPSHGYG | 2 | EPGKGT | 18 | EYPYKHSGYYHRP | 28 |
| 1784F03 | 3.8^ | 2 | 150.2, 26 ± 13 | SWRPPIHAYG | 3 | EIVEGT | 19 | EYTFKHSGYYHRP | 29 |
| 1784F03-m1 | nd | nd | nd, >2000 | SWDAPIHAYG | 4 | EGSEGT | 20 | EYTFKHSGYYHRP | 29 |
| 1784F03-m2 | nd | nd | nd, >2000 | SWDAPAHAYG | 5 | EGSKGT | 21 | EYTFKHSGYYHRP | 29 |
| 1784F03-m3 | nd | nd | nd, >2000 | SWDAPAVTYG | 6 | EGSKST | 22 | EYTFKHSGYYHRP | 29 |
| 1813E02 | <2^ | 1.3 | nd, 16 | SWSPPANGYG | 7 | EVGRGT | 23 | EYTYKGSGYYHRP | 30 |
| 1923B02 | 0.173* | 2.3 | 178.0, 23 ± 7 | SWTPPPKGYG | 8 | EVGEGT | 24 | EYTYNGAGYYHRP | 31 |
| 1923B02 (N82I) | nd | nd | nd, 14 | SWTPPPKGYG | 8 | EVGEGT | 24 | EYTYIGAGYYHRP | 32 |
| 1923B02 (N82E) | nd | nd | nd, 28 | SWTPPPKGYG | 8 | EVGEGT | 24 | EYTYEGAGYYHRP | 33 |
| 1923B02 (T80A) | nd | nd | nd, 42 | SWTPPPKGYG | 8 | EVGEGT | 24 | EYAYNGAGYYHRP | 34 |
| 1922G04 | 0.09* | 1.2 | 105.1, 10 ± 2 | SWRPPSHAYG | 9 | EIGKGT | 25 | EYPWKGSGYYHRP | 35 |
| 1922G04 (R25D) | nd | 2.5 | nd, 29 ± 8 | SWDPPSHAYG | 10 | EIGKGT | 25 | EYPWKGSGYYHRP | 35 |
| 1922G04 (R25E) | nd | 3.5 | nd, 29 ± 18 | SWEPSSHAYG | 11 | EIGKGT | 25 | EYPWKGSGYYHRP | 35 |

TABLE 3-continued

Anti-PCSK9 Adnectin BC, DE and FG Loops

| Clone ID | Affinity K$_D$, nM | PCSK9-EGFA FRET (EC$_{50}$, nM) | LDLR Depletion (% inhibition at 75 nM, EC$_{50}$ (nM)) | BC Loop | SEQ ID NO | DE Loop | SEQ ID NO | FG loop | SEQ ID NO: |
|---|---|---|---|---|---|---|---|---|---|
| 1922G04 (R25S) | nd | nd | nd, 21 | SWSPPSHAYG | 12 | HIGKGT | 25 | EYPWKGSGYYHRP | 35 |
| 2012A04 | 0.25* | 2.1 | 144.5, 12 ± 6 | SWRPPSNGHG | 13 | HVNEGT | 26 | EFPFKWSGYYHRP | 36 |
| 2013E01 | 1.51† 0.29* | 1.6 | 165.5, 10 ± 4 | SWVPPSDDYG | 14 | HIGKGT | 25 | EFPWPHAGYYHRP | 37 |
| 2011H05 | 0.08* | 2.7 | 197.6, 12 ± 5 | SWVPSSHAYG | 15 | HVGVGT | 27 | EYAFEGAGYYHRP | 38 |
| 2011H05 (V23D) | nd | 5.5 | nd, 18 ± 3 | SWDPSSHAYG | 16 | HVGVGT | 27 | EYAFEGAGYYHRP | 38 |
| 2011H05 (V23E) | nd | 7.4 | nd, 12 ± 3 | SWEPSSHAYG | 17 | HVGVGT | 27 | EYAFEGAGYYHRP | 38 |
| 2381B02(1) | 3.29† | 2.5 | 125.4, nd | SWEPFSRLPGGGE | 106 | HGSKGT | 21 | EYPYDYSGYYHRP | 142 |
| 2381B04(1) | 0.527† | 2.4 | 121.6, nd | SWEPFSRLPGGGE | 106 | HGSKGT | 21 | EYPYEHSGYYHRP | 143 |
| 2381B06(1) | nd | 3.5 | 119.7, nd | SWEPFSRLPGGGE | 106 | HGSKGT | 21 | EYPYPHSGYYHRP | 144 |
| 2381B08 | 4.11† | 2.6 | 124.8, nd | SWDAPADGGYG | 107 | HSSKGT | 136 | EYTFPGAGYYHRP | 145 |
| 2381D02(1) | nd | 3.1 | 185.0, nd | SWEPFSRLPGGGE | 106 | HGSKGT | 21 | EYPYDHSGYYHRP | 146 |
| 2381D04(1) | 0.237† | 2.9 | 119.2, nd | SWEPFSRLPGGGE | 106 | HGSKGT | 21 | EFPYDHSGYYHRP | 147 |
| 2381F11 | 1.59† | 4 | 110.2, nd | SWDAPADGGYG | 107 | HVSKGT | 137 | EYTFPGAGYYHRP | 145 |
| 2381G03(1) | nd | 3.4 | 70.2, nd | SWEPFSRLPGGGE | 106 | HGSKGT | 21 | EFPYAHSGYYHRP | 148 |
| 2381G09 | 1.12† | 3.1 | 133.0, nd | SWDAPAGDGYG | 108 | HVSKGT | 138 | EFTFPGAGYYHRP | 149 |
| 2381H03(1) | nd | 3.4 | 89.8, nd | SWEPFSRLPGGGE | 106 | HGSKGT | 21 | EYPYAHSGYFHRP | 150 |
| 2382A01 | nd | 12.9 | 119.8, nd | SWAAPAGGGYG | 109 | HVSKGT | 138 | EYDFPGAGYYHRP | 151 |
| 2382B10 | 2.35† | 3 | 100.2, nd | SWDAPADAYG | 110 | HSSKGT | 136 | EYDFPGSGYYHRP | 152 |
| 2382B09 | 0.656† | 3.8 | 105.0, nd | SWDAPADAYG | 110 | HVSKGT | 138 | EFDYPGSGYYHRP | 153 |
| 2382C05 | 2.49† | 4 | 105.3, nd | SWDAPADGAYG | 111 | HVSKGT | 138 | EYSFPGAGYYHRP | 154 |
| 2382C09 | 0.757† | 3.5 | 121.7, nd | SWDAPAEGYG | 112 | HVSKGT | 138 | EFDFPGSGYYHRP | 155 |
| 2382D03 | 1.53† | 3.3 | 80.4, nd | SWDAPADEAYG | 113 | HVSKGT | 138 | EFDFPGAGYYHRP | 156 |
| 2382D05 | 0.314† | 2.6 | 140.5, nd | SWDAPADGGYG | 107 | HVSKGT | 138 | EFDFPGAGYYHRP | 156 |
| 2382D08 | nd | 3.1 | 106.6, nd | SWDAPADGYG | 114 | HVSKGT | 138 | EFPFPGSGYYHRP | 157 |
| 2382D09 | 0.304† | 2.6 | 109.1, nd | SWDAPAEGYG | 112 | HVSKGT | 138 | EFDFPGAGYYHRP | 156 |
| 2382F02 | nd | 2.6 | −6.3, nd | SWDAPAGGGYG | 115 | HVSKGT | 138 | EFDFPGSGYYHRP | 155 |
| 2382F03 | nd | 2.7 | 88.6, nd | SWDAPAADAYG | 116 | HVSKGT | 138 | EFNDFPGAGYYHRP | 158 |
| 2382F05 | 4.54† | 2.4 | 72.2, nd | SWDAPAEAGKHYG | 117 | HVSKGT | 138 | EFDFPGAGYYHRP | 156 |
| 2382F08 | nd | 2.5 | 105.0, nd | SWDAPAEAYG | 118 | HVSKGT | 138 | EFTYPGSGYYHRP | 159 |
| 2382F09 | nd | 3.1 | 109.7, nd | SWDAPAAAYG | 119 | HVSKGT | 138 | EYDFPGSGYYHRP | 152 |
| 2382G04 | 1.11† | 2.9 | 146.1, nd | SWDAPAGGGYG | 115 | HSSKGT | 136 | EFDFPGAGYYHRP | 156 |
| 2382H10 | 1.40† | 2.6 | 118.6, nd | SWDAPAGGYG | 120 | HVSKGT | 138 | EFDFPGSGYYHRP | 155 |

TABLE 3-continued

Anti-PCSK9 Adnectin BC, DE and FG Loops

| Clone ID | Affinity $K_D$, nM | PCSK9-EGFA FRET ($EC_{50}$, nM) | LDLR Depletion (% inhibition at 75 nM, $EC_{50}$ (nM)) | BC Loop | SEQ ID NO | DE Loop | SEQ ID NO | FG loop | SEQ ID NO: |
|---|---|---|---|---|---|---|---|---|---|
| 2382H11 | nd | 2.9 | 117.2, nd | SWDAPADGYG | 114 | PVFKGT | 139 | EFDYPGSGYYHRP | 153 |
| 2382H04 | nd | 3.2 | 68.2, nd | SWDAPAAGGYG | 121 | PSSKGT | 136 | EYDFPGAGYYHRP | 151 |
| 2382H07 | nd | 2.7 | 86.2, nd | SWDAPADAYG | 110 | PGSKGT | 21 | EFDFPGSGYYHRP | 155 |
| 2382H09 | 1.86† | 0.9 | 101.2, nd | SWDAPAAAYG | 119 | PSSKGT | 136 | EFDFPGSGYYHRP | 155 |
| 2451A02 | nd | 3.2 | 106.4, nd | SWDAPAAGYG | 122 | PVSKGT | 138 | EFPFPGSGYYHRP | 157 |
| 2451B05 | nd | 6.3 | 91.7, nd | SWDAPAGGYG | 120 | PSSKGT | 136 | EFDYPGSGYYHRP | 153 |
| 2451B06 | nd | 4.5 | 92.2, nd | SWDAPADGGYG | 107 | PVSKGT | 138 | EFDFPGAGYYHRP | 156 |
| 2451C06 | 1.27† | 1.2 | 89.4, nd | SWDAPAGAASYG | 123 | PVSKGT | 138 | EFPFPGAGYYHRP | 160 |
| 2451D05 | nd | 2.8 | 115.0, nd | SWDAPAGAYG | 124 | PVSKGT | 138 | EFDFPGSGYYHRP | 155 |
| 2451F03 | nd | 2.8 | 113.2, nd | SWDPPAEGYG | 125 | PVSKGT | 138 | EFNFPGSGYYHRP | 161 |
| 2451G01 | nd | 3.8 | 90.8, nd | SWDAPAGGYG | 120 | PSSKGT | 136 | EFDFPGSGYYHRP | 155 |
| 2451H07(2) | 2.08† | 0.2 | 88.8, nd | SWNPPDVNYG | 126 | PVSKGT | 138 | EYPYAHAGYYHRP | 162 |
| 2382E03 | 2.94† | 2.4 | 89.5, nd | SWDAPAGDGYG | 108 | PVSKGT | 138 | EFDFPGAGYYHRP | 156 |
| 2382E04 | nd | 3 | 61.5, nd | SWDAPAGGGYG | 115 | PVSKGT | 138 | EFTFPGAGYYHRP | 149 |
| 2382E05 | 0.604† | 2.8 | 103.5, nd | SWDAPAEGGYG | 127 | PVSKGT | 138 | EFDFPGAGYYHRP | 156 |
| 2382E09 | nd | 6.2 | 97.2, nd | SWDAPAEAYG | 118 | PVSKGT | 138 | EYDFPGSGYYHRP | 152 |
| 2381A04(1) | nd | 3.3 | 100.1, nd | SWEPFSRLPGGGE | 106 | PGSKGT | 21 | EYPYPFSGYYHRP | 163 |
| 2381A08 | nd | 3.6 | 91.4, nd | SWDAPADGGYG | 107 | PGSKGT | 21 | EYDFPGAGYYHRP | 151 |
| 2381B10 | nd | 7.3 | 96.4, nd | SWDAPAGGGYG | 115 | PVSKGT | 138 | EYNFGAGYYHRP | 164 |
| 2381C08 | nd | 0.7 | 15.3, nd | SWDAPADGAYG | 111 | PVSKGT | 138 | EFPYPFAGYYHRP | 165 |
| 2381G06(3) | nd | 9 | 57.7, nd | SWSEKLDGKARRG | 128 | PGSKGT | 21 | EFPYDHSGYYHRP | 147 |
| 2381H01(3) | nd | 4 | 22.2, nd | SWSPRDSTGLVRRG | 129 | PGSKGT | 21 | EYPYDHSGYYHRP | 146 |
| 2381H06(4) | nd | 5 | 53.4, nd | SWGDVRTNEARQG | 130 | PGSKGT | 21 | EYTYPHSGYYHRP | 166 |
| 2381H09 | 3.23† | 3.4 | 94.4, nd | SWDAPAGGGYG | 115 | PVSKGT | 138 | EFDFVGAGYYHRP | 167 |
| 2382B11 | nd | 2.9 | 88.8, nd | SWDAPAAAYG | 119 | PVSKGT | 138 | EYDFAGSGYYHRP | 168 |
| 2382B08 | nd | 2.9 | 107.2, nd | SWDAPADAYG | 110 | PSSKGT | 136 | EFAFPGAGYYHRP | 169 |
| 2382C11 | nd | 3.7 | 82.9, nd | SWDAPAGGYG | 120 | PVSKGT | 138 | EYDFAGSGYYHRP | 168 |
| 2382G03 | nd | 2.7 | 77.8, nd | SWDAPAEAEAYG | 131 | PVSKGT | 138 | EYVFPGAGYYHRP | 170 |
| 2382H03 | 0.677† | 3.4 | 102.1, nd | SWDAPAEGAYG | 132 | PVSKGT | 138 | EYPYPFAGYYHRP | 171 |
| 2451A10(5) | nd | 10.9 | 53.7, nd | SWQPPAVTYG | 133 | PVYKGT | 140 | EYPYDHSGYYHRP | 146 |
| 2451B02 | nd | 5.3 | 71.4, nd | SWDAPAAAYG | 119 | PVSKGT | 138 | EFDYPGSGYYHRP | 153 |
| 2451C11(6) | nd | 9.7 | 70.3, nd | SWDPPAGAYG | 134 | PGYKGT | 141 | EYPYDHSGYYHRP | 146 |
| 2451H01 | nd | 2.8 | 95.8, nd | SWDAPAAGYG | 122 | PVSKGT | 138 | EYDFPGSGYYHRP | 152 |
| 2011B11 | nd | 1.7 | 144.5, nd | SWAPPSDAYG | 135 | PIGKGT | 25 | EYPYSHAGYYHRP | 172 |

TABLE 3-continued

Anti-PCSK9 Adnectin BC, DE and FG Loops

| Clone ID | Affinity K_D, nM | PCSK9-EGFA FRET (EC_50, nM) | LDLR Depletion (% inhibition at 75 nM, EC_50 (nM)) | BC Loop | SEQ ID NO | DE Loop | SEQ ID NO | FG loop | SEQ ID NO: |
|---|---|---|---|---|---|---|---|---|---|
| 2971A03 | 0.806† | nd | 120.1, nd | SWDPPSDDYG | 301 | PIGKGT | 25 | EFPWPHAGYYHRP | 37 |
| 2971A09 | 2.79† | nd | 132.3, nd | SWDAPADDYG | 302 | PIGKGT | 25 | EFPWPHAGYYHRP | 37 |
| 2971E02 | 1.78† | nd | 126.2, nd | SWDAPSDDYG | 303 | PIGKGT | 25 | EFPWPHAGYYHRP | 37 |

†K_D determined using Octet Red at 37° C.; *K_D determined using ProteOn at 25° C.; ^K_D determined using ITC at 37° C.; (1) In addition to mutations in the loops, these clones also have the mutations V45L and E47Q; (2) In addition to mutations in the loops, this clone also has the mutations V1I, S2T, and V45L; (3) In addition to mutations in the loops, these clones also have the mutation E47Q; (4) In addition to mutations in the loops, this clone also has the mutations V45L and E47G; (5) In addition to mutations in the loops, this clone also has the mutations S2T, L8M, P44T, V45L, and E47Q; (6) In addition to mutations in the loops, this clone also has the mutations V1I, S2V, V45K, and E47Q.

The SEQ ID NOS of the family of anti-PCSK9 Adnectin of the invention are presented in Table 4.

TABLE 4

Anti-PCSK9 Adnectin Family

| Clone | Amino Acid (Sequence) | Nucleic Acid (Sequence) |
|---|---|---|
| 1459D05 also referred to as ATI000891 or ATI-891 | MGVSDVPRDLEVVAATPTSLLI SWPPPSHGYGYYRITYGETGGN SPVQEFTVPPGKGTATISGLKP GVDYTITVYAVEYPYKHSGYYH RPISINYRTEIDKPSQHHHHHH (SEQ ID NO: 39) | ATGGGAGTTTCTGATGTGCCGCGCGACCTGGAAGTGGTTGCTGCCACCCCCACCAGCCTGCTGA TCAGCTGGCCGCCGCCGTCTCATGGTTACGGTTATTACCGCATCACTTACGGCGAAACAGGAGG CAATAGCCCTGTCCAGGAGTTCACTGTGCCGCCTGGTAAAGGTACAGCTACCATCAGCGGCCTT AAACCTGGCGTTGATTATACCATCACTGTGTATGCTGTCGAATACCCGTACAAACATTCCGGTT ACTACCATCGTCCAATTTCCATTAATTACCGCACAGAAATTGACAAACCATCCCAGCACCATCA CCACCACCAC (SEQ ID NO: 40) |
| 1784F03 | MGVSDVPRDLEVVAATPTSLLI SWRPPIHAYGYYRITYGETGGN SPVQEFTVPPGKGTATISGLKP GVDYTITVYAVEYTFKHSGYYH RPISINYRTEIDKPSQHHHHHH (SEQ ID NO: 41) | ATGGGAGTTTCTGATGTGCCGCGCGACCTGGAAGTGGTTGCTGCCACCCCCACCAGCCTGCTGA TCAGCTGGAGGCCGCCGATTCATGCTTACGGGTATTACCGCATCACTTACGGCGAAACAGGAGG CAATAGCCCTGTCCAGGAGTTCACTGTGCCTATTGTTGAAGGTACAGCTACCATCAGCGGCCTT AAACCTGGCGTTGATTATACCATCACTGTGTATGCTGTCGAATATACATTTAAACATTCCGGTT ACTACCATCGTCCAATTTCCATTAATTACCGCACAGAAATTGACAAACCATCCCAGCACCATCA CCACCACCAC (SEQ ID NO: 42) |
| 1784F03-m1 | MGVSDVPRDLEVVAATPTSLLI SWDAPIHAYGYYRITYGETGGN SPVQEFTVPGSEGTATISGLKP GVDYTITVYAVEYTFKHSGYYH RPISINYRTEIDKPSQHHHHHH (SEQ ID NO: 43) | ATGGGAGTTTCTGATGTGCCGCGCGACCTGGAAGTGGTTGCTGCCACCCCCACCAGCCTGCTGA TCAGCTGGGACGCTCCGATTCATGCTTACGGGTATTACCGCATCACTTACGGCGAAACAGGAGG CAATAGCCCTGTCCAGGAGTTCACTGTGCCTGGTTCTGAAGGTACAGCTACCATCAGCGGCCTT AAACCTGGCGTTGATTATACCATCACTGTGTATGCTGTCGAATATACATTTAAACATTCCGGTT ACTACCATCGTCCAATTTCCATTAATTACCGCACAGAAATTGACAAACCATCCCAGCACCATCA CCACCACCAC (SEQ ID NO: 44) |
| 1784F03-m2 | MGVSDVPRDLEVVAATPTSLLI SWDAPAHAYGYYRITYGETGGN SPVQEFTVPGSKGTATISGLKP GVDYTITVYAVEYTFKHSGYYH RPISINYRTEIDKPSQHHHHHH (SEQ ID NO: 45) | ATGGGAGTTTCTGATGTGCCGCGCGACCTGGAAGTGGTTGCTGCCACCCCCACCAGCCTGCTGA TCAGCTGGGACGCTCCGGCTCATGCTTACGGGTATTACCGCATCACTTACGGCGAAACAGGAGG CAATAGCCCTGTCCAGGAGTTCACTGTGCCTGGTTCTAAAGGTACAGCTACCATCAGCGGCCTT AAACCTGGCGTTGATTATACCATCACTGTGTATGCTGTCGAATATACATTTAAACATTCCGGTT ACTACCATCGTCCAATTTCCATTAATTACCGCACAGAAATTGACAAACCATCCCAGCACCATCA CCACCACCAC (SEQ ID NO: 46) |
| 1784F03-m3 | MGVSDVPRDLEVVAATPTSLLI SWDAPAVTYGYYRITYGETGGN SPVQEFTVPGSKSTATISGLKP GVDYTITVYAVEYTFKHSGYYH RPISINYRTEIDKPSQHHHHHH (SEQ ID NO: 47) | ATGGGAGTTTCTGATGTGCCGCGCGACCTGGAAGTGGTTGCTGCCACCCCCACCAGCCTGCTGA TCAGCTGGGACGCTCCGGCTGTTACTTACGGGTATTACCGCATCACTTACGGCGAAACAGGAGG CAATAGCCCTGTCCAGGAGTTCACTGTGCCTGGTTCTAAATCTACAGCTACCATCAGCGGCCTT AAACCTGGCGTTGATTATACCATCACTGTGTATGCTGTCGAATATACATTTAAACATTCCGGTT ACTACCATCGTCCAATTTCCATTAATTACCGCACAGAAATTGACAAACCATCCCAGCACCATCA CCACCACCAC (SEQ ID NO: 48) |
| 1813E02 | MGVSDVPRDLEVVAATPTSLLI SWSPPANGYGYYRITYGETGGN SPVQEFTVPVGRGTATISGLKP GVDYTITVYAVEYTYKGSGYYH RPISINYRTEIDKPSQHHHHHH (SEQ ID NO: 49) | ATGGGAGTTTCTGATGTGCCGCGCGACCTGGAAGTGGTTGCTGCCACCCCCACCAGCCTGCTGA TCAGCTGGTCTCCCCACCGGCTAACGGTTACGGTTATTACCGCATCACTTACGGCGAAACAGGAGG CAATAGCCCTGTCCAGGAGTTCACTGTGCCTGTTGGTAGAGGTACAGCTACCATCAGCGGCCTT AAACCTGGCGTTGATTATACCATCACTGTGTATGCTGTCGAGTATACCTACAAAGGCTCTGGTT ACTACCATCGCCCAATTTCCATTAATTACCGCACAGAAATTGACAAACCATCCCAGCACCATCA CCACCACCAC (SEQ ID NO: 50) |
| 1923B02 | MGVSDVPRDLEVVAATPTSLLI SWTPPPKGYGYYRITYGETGGN SPVQEFTVPVGEGTATISGLKP GVDYTITVYAVEYTYNGAGYYH RPISINYRTEIDKPSQHHHHHH (SEQ ID NO: 51) | ATGGGAGTTTCTGATGTGCCGCGCGACCTGGAAGTGGTTGCTGCCACCCCCACCAGCCTGCTGA TCAGCTGGACGCCTCCCCCTAAAGGGTATGGTTATTACCGCATCACTTACGGCGAAACAGGAGG CAATAGCCCTGTCCAGGAGTTCACTGTGCCTGTTGGTGAAGGTACAGCTACCATCAGCGGCCTT AAACCTGGCGTTGATTATACCATCACTGTGTATGCTGTCGAATACACGTACAACGGTGCCGGTT ACTACCACCGGCCAATTTCCATTAATTACCGCACAGAAATTGACAAACCATCCCAGCACCATCA CCACCACCAC (SEQ ID NO: 52) |

TABLE 4-continued

Anti-PCSK9 Adnectin Family

| Clone | Amino Acid | Nucleic Acid |
|---|---|---|
| 1923B02(N82I) | MGVSDVPRDLEVVAATPTSLLI SWTPPPKGYGYYRITYGETGGN SPVQEFTVPVGEGTATISGLKP GVDYTITVYAVEYTYIGAGYYH RPISINYRTGSGSHHHHHH (SEQ ID NO: 53) | ATGGGAGTTTCTGATGTGCCGCGCGACCTGGAAGTGGTTGCTGCCACCCCCACCAGCCTGCTGA TCAGCTGGACGCCTCCCCCTAAAGGGTATGGTTATTACCGCATCACTTACGGCGAAACAGGAGG CAATAGCCCTGTCCAGGAGTTCACTGTGCCTGTTGGTGAAGGTACAGCTACCATCAGCGGCCTT AAACCTGGCGTTGATTATACCATCACTGTGTATGCTGTCGAATACACGTACATTGGTGCCGGTT ACTACCACCGGCCAATTTCCATTAATTACCGCACAGGTAGCGGTTCCCACCATCACCACCATCA C (SEQ ID NO: 54) |
| 1923B02(N82E) | MGVSDVPRDLEVVAATPTSLLI SWTPPPKGYGYYRITYGETGGN SPVQEFTVPVGEGTATISGLKP GVDYTITVYAVEYTYEGAGYYH RPISINYRTGSGSHHHHHH (SEQ ID NO: 55) | ATGGGAGTTTCTGATGTGCCGCGCGACCTGGAAGTGGTTGCTGCCACCCCCACCAGCCTGCTGA TCAGCTGGACGCCTCCCCCTAAAGGGTATGGTTATTACCGCATCACTTACGGCGAAACAGGAGG CAATAGCCCTGTCCAGGAGTTCACTGTGCCTGTTGGTGAAGGTACAGCTACCATCAGCGGCCTT AAACCTGGCGTTGATTATACCATCACTGTGTATGCTGTCGAATACACGTACGAAGGTGCCGGTT ACTACCACCGGCCAATTTCCATTAATTACCGCACAGGTAGCGGTTCCCACCATCACCACCATCA C (SEQ ID NO: 56) |
| 1923B02(T80A) | MGVSDVPRDLEVVAATPTSLLI SWTPPPKGYGYYRITYGETGGN SPVQEFTVPVGEGTATISGLKP GVDYTITVYAVEYAYNGAGYYH RPISINYRTGSGSHHHHHH (SEQ ID NO: 57) | ATGGGAGTTTCTGATGTGCCGCGCGACCTGGAAGTGGTTGCTGCCACCCCCACCAGCCTGCTGA TCAGCTGGACGCCTCCCCCTAAAGGGTATGGTTATTACCGCATCACTTACGGCGAAACAGGAGG CAATAGCCCTGTCCAGGAGTTCACTGTGCCTGTTGGTGAAGGTACAGCTACCATCAGCGGCCTT AAACCTGGCGTTGATTATACCATCACTGTGTATGCTGTCGAATACGCGTACAACGGTGCCGGTT ACTACCACCGGCCAATTTCCATTAATTACCGCACAGGTAGCGGTTCCCACCATCACCACCATCA C (SEQ ID NO: 58) |
| 1922G04 also referred to herein as ATI001057 or ATI-1057 | MGVSDVPRDLEVVAATPTSLLI SWRPPSHAYGYYRITYGETGGN SPVQEFTVPIGKGTATISGLKP GVDYTITVYAVEYPWKGSGYYH RPISINYRTEIDKPSQHHHHHH (SEQ ID NO: 59) | ATGGGAGTTTCTGATGTGCCGCGCGACCTGGAAGTGGTTGCTGCCACCCCCACCAGCCTGCTGA TCAGCTGGCGGCCGCCATCTCATGCTTATGGTTATTACCGCATCACTTACGGCGAAACAGGAGG CAATAGCCCTGTCCAGGAGTTCACTGTGCCTATTGGGAAAGGTACAGCTACCATCAGCGGCCTT AAACCTGGCGTTGATTATACCATCACTGTGTATGCTGTCGAATACCCGTGGAAAGGTTCTGGTT ACTACCATCGGCCAATTTCCATTAATTACCGCACAGAAATTGACAAACCATCCCAGCACCATCA CCACCACCAC (SEQ ID NO: 60) |
| 1922G04(R25D) | MGVSDVPRDLEVVAATPTSLLI SWDPPSHAYGYYRITYGETGGN SPVQEFTVPIGKGTATISGLKP GVDYTITVYAVEYPWKGSGYYH RPISINYRTGSGSHHHHHH (SEQ ID NO: 61) | ATGGGAGTTTCTGATGTGCCGCGCGACCTGGAAGTGGTTGCTGCCACCCCCACCAGCCTGCTGA TCAGCTGGGACCCGCCATCTCATGCTTATGGTTATTACCGCATCACTTACGGCGAAACAGGAGG CAATAGCCCTGTCCAGGAGTTCACTGTGCCTATTGGGAAAGGTACAGCTACCATCAGCGGCCTT AAACCTGGCGTTGATTATACCATCACTGTGTATGCTGTCGAATACCCGTGGAAAGGTTCTGGTT ACTACCATCGGCCAATTTCCATTAATTACCGCACAGGTAGCGGTTCCCACCATCACCACCATCA C (SEQ ID NO: 62) |
| 1922G04(R25E) | MGVSDVPRDLEVVAATPTSLLI SWEPPSHAYGYYRITYGETGGN SPVQEFTVPIGKGTATISGLKP GVDYTITVYAVEYPWKGSGYYH RPISINYRTGSGSHHHHHH (SEQ ID NO: 63) | ATGGGAGTTTCTGATGTGCCGCGCGACCTGGAAGTGGTTGCTGCCACCCCCACCAGCCTGCTGA TCAGCTGGGAACCGCCATCTCATGCTTATGGTTATTACCGCATCACTTACGGCGAAACAGGAGG CAATAGCCCTGTCCAGGAGTTCACTGTGCCTATTGGGAAAGGTACAGCTACCATCAGCGGCCTT AAACCTGGCGTTGATTATACCATCACTGTGTATGCTGTCGAATACCCGTGGAAAGGTTCTGGTT ACTACCATCGGCCAATTTCCATTAATTACCGCACAGGTAGCGGTTCCCACCATCACCACCATCA C (SEQ ID NO: 64) |
| 1922G04(R25S) | MGVSDVPRDLEVVAATPTSLLI SWSPPSHAYGYYRITYGETGGN SPVQEFTVPIGKGTATISGLKP GVDYTITVYAVEYPWKGSGYYH RPISINYRTGSGSHHHHHH (SEQ ID NO: 65) | ATGGGAGTTTCTGATGTGCCGCGCGACCTGGAAGTGGTTGCTGCCACCCCCACCAGCCTGCTGA TCAGCTGGAGCCCGCCATCTCATGCTTATGGTTATTACCGCATCACTTACGGCGAAACAGGAGG CAATAGCCCTGTCCAGGAGTTCACTGTGCCTATTGGGAAAGGTACAGCTACCATCAGCGGCCTT AAACCTGGCGTTGATTATACCATCACTGTGTATGCTGTCGAATACCCGTGGAAAGGTTCTGGTT ACTACCATCGGCCAATTTCCATTAATTACCGCACAGGTAGCGGTTCCCACCATCACCACCATCA C (SEQ ID NO: 66) |
| 2012A04 | MGVSDVPRDLEVVAATPTSLLI SWRPPSNGHGYYRITYGETGGN SPVQEFTVPVNEGTATISGLKP GVDYTITVYAVEFPFKWSGYYH RPISINYRTEIDKPSQHHHHHH (SEQ ID NO: 67) | ATGGGAGTTTCTGATGTGCCGCGCGACCTGGAAGTGGTTGCTGCCACCCCCACCAGCCTGCTGA TCAGCTGGCGCCCCCCCTCTAATGGTCACGGTTATTACCGCATCACTTACGGCGAAACAGGAGG CAATAGCCCTGTCCAGGAGTTCACTGTGCCTGTTAATGAAGGTACAGCTACCATCAGCGGCCTT AAACCTGGCGTTGATTATACCATCACTGTGTATGCTGTCGAATTCCCCTTCAAGTGGTCGGGCT ACTACCATCGACCAATTTCCATTAATTACCGCACAGAAATTGACAAACCATCCCAGCACCATCA CCACCACCAC (SEQ ID NO: 68) |
| 2013E01 also referred to as ATI001081 or ATI-1081 | MGVSDVPRDLEVVAATPTSLLI SWVPPSDDYGYYRITYGETGGN SPVQEFTVPIGKGTATISGLKP GVDYTITVYAVEFPWPHAGYYH RPISINYRTEIDKPSQHHHHHH (SEQ ID NO: 69) | ATGGGAGTTTCTGATGTGCCGCGCGACCTGGAAGTGGTTGCTGCCACCCCCACCAGCCTGCTGA TCAGCTGGGTCCCGCCTTCAGATGATTACGGTTATTACCGCATCACTTACGGCGAAACAGGAGG CAATAGCCCTGTCCAGGAGTTCACTGTGCCTATTGGTAAAGGAACAGCTACCATCAGCGGCCTT AAACCTGGCGTTGATTATACCATCACTGTGTATGCTGTCGAGTTTCCGTGGCCACATGCTGGTT ACTATCATCGGCCAATTTCCATTAATTACCGCACAGAAATTGACAAACCATCCCAGCACCATCA CCACCACCAC (SEQ ID NO: 70) |
| 2011H05 also referred to as ATI001091 or ATI-1091 | MGVSDVPRDLEVVAATPTSLLI SWVPSSHAYGYYRITYGETGGN SPVQEFTVPVGVGTATISGLKP GVDYTITVYAVEYAFEGAGYYH RPISINYRTEIDKPSQHHHHHH (SEQ ID NO: 71) | ATGGGAGTTTCTGATGTGCCGCGCGACCTGGAAGTGGTTGCTGCCACCCCCACCAGCCTGCTGA TCAGCTGGGTTCCGTCGTCTCATGCCTACGGTTATTACCGCATCACTTACGGCGAAACAGGAGG CAATAGCCCTGTCCAGGAGTTCACTGTGCCTGTGGGGTAGGTACAGCTACCATCAGCGGCCTT AAACCTGGCGTTGATTATACCATCACTGTGTATGCTGTCGAATACGCTTTCGAAGGGGCTGGTT ACTACCATCGTCCAATTTCCATTAATTACCGCACAGAAATTGACAAACCATCCCAGCACCATCA CCACCACCAC (SEQ ID NO: 72) |
| 2011H05(V23D) | MGVSDVPRDLEVVAATPTSLLI SWDPSSHAYGYYRITYGETGGN SPVQEFTVPVGVGTATISGLKP | ATGGGAGTTTCTGATGTGCCGCGCGACCTGGAAGTGGTTGCTGCCACCCCCACCAGCCTGCTGA TCAGCTGGGACCCGTCGTCTCATGCCTACGGTTATTACCGCATCACTTACGGCGAAACAGGAGG CAATAGCCCTGTCCAGGAGTTCACTGTGCCTGTGGGGTAGGTACAGCTACCATCAGCGGCCTT |

TABLE 4-continued

Anti-PCSK9 Adnectin Family

| Clone | Amino Acid | Nucleic Acid |
|---|---|---|
| | GVDYTITVYAVEYAFEGAGYYH RPISINYRTEIDKPSQHHHHHH (SEQ ID NO: 73) | AAACCTGGCGTTGATTATACCATCACTGTGTATGCTGTCGAATACGCTTTCGAAGGGGCTGGTT ACTACCATCGTCCAATTTCCATTAATTACCGCACAGAAATTGACAAACCATCCCAGCACCATCA CCACCACCAC (SEQ ID NO: 74) |
| 2011H05(V23E) | MGVSDVPRDLEVVAATPTSLLI SWEPSSHAYGYYRITYGETGGN SPVQEFTVPVGVGTATISGLKP GVDYTITVYAVEYAFEGAGYYH RPISINYRTEIDKPSQHHHHHH (SEQ ID NO: 75) | ATGGGAGTTTCTGATGTGCCGCGCGACCTGGAAGTGGTTGCTGCCACCCCCACCAGCCTGCTGA TCAGCTGGGAACCGTCCGTCTCATGCCTACGGTTATTACCGCATCACTTACGGCGAAACAGGAGG CAATAGCCCTGTCCAGGAGTTCACTGTGCCTGTGGGGGTAGGTACAGCTACCATCAGCGGCTT AAACCTGGCGTTGATTATACCATCACTGTGTATGCTGTCGAATACGCTTTCGAAGGGGCTGGTT ACTACCATCGTCCAATTTCCATTAATTACCGCACAGAAATTGACAAACCATCCCAGCACCATCA CCACCACCAC (SEQ ID NO: 76) |
| 2381B02 | MGVSDVPRDLEVVAATPTSLLI SWEPFSRLPGGGEYYRITYGET GGNSPLQQFTVPGSKGTATISG LKPGVDYTITVYAVEYPYDYSG YYHRPISINYRTEIDKPSQHHH HHH (SEQ ID NO: 173) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACGACT ATTCTGGTTACTACCATCGCCCCATTTCCATTAATTACCGCACAGAAATTGACAAACCATCCCA GCACCATCACCACCACCAC (SEQ ID NO: 174) |
| 2381B04 | MGVSDVPRDLEVVAATPTSLLI SWEPFSRLPGGGEYYRITYGET GGNSPLQQFTVPGSKGTATISG LKPGVDYTITVYAVEYPYEHSG YYHRPISINYRTEIDKPSQHHH HHH (SEQ ID NO: 175) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACGAGC ATTCTGGTTACTATCATCGTCCGATTTCCATTAATTACCGCACAGAAATTGACAAACCATCCCA GCACCATCACCACCACCAC (SEQ ID NO: 176) |
| 2381B06 | MGVSDVPRDLEVVAATPTSLLI SWEPFSRLPGGGEYYRITYGET GGNSPLQQFTVPGSKGTATISG LKPGVDYTITVYAVEYPYPHSG YYHRPISINYRTEIDKPSQHHH HHH (SEQ ID NO: 177) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACCCGC ATTCTGGTTACTACCATCGACCGATTTCCATTAATTACCGCACAGAAATTGACAAACCATCCCA GCACCATCACCACCACCAC (SEQ ID NO: 178) |
| 2381B08 | MGVSDVPRDLEVVAATPTSLLI SWDAPADGGYGYYRITYGETGG NSPVQEFTVPSSKGTATISGLK PGVDYTITVYAVEYTFPGAGYY HRPISINYRTEIDKPSQHHHHH H (SEQ ID NO: 179) | ATGGGAGTTTCTGATGTGCCGCGCGACCTGGAAGTGGTTGCTGCCACCCCCACCAGCCTGCTGA TCAGCTGGGACGCTCCGGCTGATGGAGGGTACGGTTATTACCGCATCACTTACGGCGAAACAGG AGGCAATAGCCCTGTCCAGGAGTTCACTGTGCCTAGTTCTAAAGGTACAGCTACCATCAGCGGC CTTAAACCTGGCGTTGATTATACCATCACTGTGTATGCTGTCGAATACACCTTCCCGGGCGCCG GTTACTACCATCGTCCAATTTCCATTAATTACCGCACAGAAATTGACAAACCATCCCAGCACCA TCACCACCACCAC (SEQ ID NO: 180) |
| 2381D02 | MGVSDVPRDLEVVAATPTSLLI SWEPFSRLPGGGEYYRITYGET GGNSPLQQFTVPGSKGTATISG LKPGVDYTITVYAVEYPYDHSG YYHRPISINYRTEIDKPSQHHH HHH (SEQ ID NO: 181) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACGACC ATTCTGGTTACTACCATCGTCCCATTTCCATTAATTACCGCACAGAAATTGACAAACCATCCCA GCACCATCACCACCACCAC (SEQ ID NO: 182) |
| 2381D04 | MGVSDVPRDLEVVAATPTSLLI SWEPFSRLPGGGEYYRITYGET GGNSPLQQFTVPGSKGTATISG LKPGVDYTITVYAVEFPYDHSG YYHRPISINYRTEIDKPSQHHH HHH (SEQ ID NO: 183) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATTCCCGTACGACC ATTCTGGTTACTACCATCGGCCCATTTCCATTAATTACCGCACAGAAATTGACAAACCATCCCA GCACCATCACCACCACCAC (SEQ ID NO: 184) |
| 2381F11 | MGVSDVPRDLEVVAATPTSLLI SWDAPADGGYGYYRITYGETGG NSPVQEFTVPVSKSTATISGLK PGVDYTITVYAVEYTFPGAGYY HRPISINYRTEIDKPSQHHHHH H (SEQ ID NO: 185) | ATGGGAGTTTCTGATGTGCCGCGCGACCTGGAAGTGGTTGCTGCCACCCCCACCAGCCTGCTGA TCAGCTGGGACGCTCCGGCTGACGGGGGTACGGTTATTACCGCATCACTTACGGCGAAACAGG AGGCAATAGCCCTGTCCAGGAGTTCACTGTGCCTGTTTCTAAAAGTACAGCTACCATCAGCGGC CTTAAACCTGGCGTTGATTATACCATCACTGTGTATGCTGTCGAATACACCTTCCCGGGCGCCG GTTACTACCATCGTCCAATTTCCATTAATTACCGCACAGAAATTGACAAACCATCCCAGCACCA TCACCACCACCAC (SEQ ID NO: 186) |
| 2381G03 | MGVSDVPRDLEVVAATPTSLLI SWEPFSRLPGGGEYYRITYGET GGNSPLQQFTVPGSKGTATISG LKPGVDYTITVYAVEFPYAHSG YYHRPISINYRTEIDKPSQHHH HHH (SEQ ID NO: 187) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATTCCCGTACGCGC ATTCTGGTACTACCATCGTCCGATTTCCATTAATTACCGCACAGAAATTGACAAACCATCCCA GCACCATCACCACCACCAC (SEQ ID NO: 188) |
| 2381G09 | MGVSDVPRDLEVVAATPTSLLI SWDAPAGDGYGYYRITYGETGG NSPVQEFTVPVSKGTATISGLK PGVDYTITVYAVEFTFPGAGYY HRPISINYRTEIDKPSQHHHHH H (SEQ ID NO: 189) | ATGGGAGTTTCTGATGTGCCGCGCGACCTGGAAGTGGTTGCTGCCACCCCCACCAGCCTGCTGA TCAGCTGGGACGCTCCGGCTGGGGACGGTTATTACCGCATCACTTACGGCGAAACAGGAGG CAATAGCCCTGTCCAGGAGTTCACTGTGCCCGTTTCTAAAGGTACAGCTACCATCAGCGGC CTTAAACCTGGCGTTGATTATACCATCACTGTGTATGCTGTCGAATTCACCTTCCCGGGCGCCG GTTACTACCATCGTCCAATTTCCATTAATTACCGCACAGAAATTGACAAACCATCCCAGCACCA TCACCACCACCAC (SEQ ID NO: 190) |

TABLE 4-continued

Anti-PCSK9 Adnectin Family

| Clone | Amino Acid | Nucleic Acid |
|---|---|---|
| 2381H03 | MGVSDVPRDLEVVAATPTSLLI SWEPFSRLPGGGEYYRITYGET GGNSPLQQFTVPGSKGTATISG LKPGVDYTITVYAVEYPYAHSG YFHRPISINYRTEIDKPSQHHH HHH (SEQ ID NO: 191) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACGCGC ATTCTGGTTACTTCCATCGTCCGATTTCCATTAATTACCGCACAGAAATTGACAAACCATCCCA GCACCATCACCACCACCAC (SEQ ID NO: 192) |
| 2382A01 | MGVSDVPRDLEVVAATPTSLLI SWAAPAGGGYGYYRITYGETGG NSPVQEFTVPVSKGTATISGLK PGVDYTITVYAVEYDFPGAGYY HRPISINYRTEIDKPSQHHHHH H (SEQ ID NO: 193) | ATGGGAGTTTCTGATGTGCCGCGCGACCTGGAAGTGGTTGCTGCCACCCCCACCAGCCTGCTGA TCAGCTGGGCCGCTCCGGCTGGTGGTGGCTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATACGACTTCCCGGGCGCCG GTTACTACCATCGTCCAATTTCCATTAATTACCGCACAGAAATTGACAAACCATCCCAGCACCA TCACCACCACCAC (SEQ ID NO: 194) |
| 2382B10 | MGVSDVPRDLEVVAATPTSLLI SWDAPADAYGYYRITYGETGGN SPVQEFTVPSSKGTATISGLKP GVDYTITVYAVEYDFPGSGYYH RPISINYRTEIDKPSQHHHHHH (SEQ ID NO: 195) | ATGGGAGTTTCTGATGTGCCGCGCGACCTGGAAGTGGTTGCTGCCACCCCCACCAGCCTGCTGA TAAGCTGGGACGCTCCGGCTGACGCGTACGGTTATTACCGCATCACTTACGGCGAAACAGGAGG CAATAGCCCTGTCCAGGAGTTCACTGTGCCTAGTTCTAAAGGTACAGCTACCATCAGCGGCCTT AAACCTGGCGTTGATTATACCATCACTGTGTATGCTGTCGAATACGACTTCCCCGGCAGCGGTT ACTACCATCGTCCAATTTCCATTAATTACCGCACAGAAATTGACAAACCATCCCAGCACCATCA CCACCACCAC (SEQ ID NO: 196) |
| 2382B09 | MGVSDVPRDLEVVAATPTSLLI SWDAPADAYGYYRITYGETGGN SPVQEFTVPVSKGTATISGLKP GVDYTITVYAVEFDYPGSGYYH RPISINYRTEIDKPSQHHHHHH (SEQ ID NO: 197) | ATGGGAGTTTCTGATGTGCCGCGCGACCTGGAAGTGGTTGCTGCCACCCCCACCAGCCTGCTGA TCAGCTGGGACGCTCCGGCTGACGCGTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTACCCCGGCTCCGGTT ACTACCATCGTCCAATTTCCATTAATTACCGCACAGAAATTGACAAACCATCCCAGCACCATCA CCACCACCAC (SEQ ID NO: 198) |
| 2382C05 | MGVSDVPRDLEVVAATPTSLLI SWDAPADGAYGYYRITYGETGG NSPVQEFTVPVSKGTATISGLK PGVDYTITVYAVEYSFPGAGYY HRPISINYRTEIDKPSQHHHHH H (SEQ ID NO: 199) | ATGGGAGTTTCTGATGTGCCGCGCGACCTGGAAGTGGTTGCTGCCACCCCCACCAGCCTGCTGA TCAGCTGGGACGCTCCGGCTGATGGGGCATACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATACTCCTTCCCCGGCGCCG GTTACTACCATCGTCCAATTTCCATTAATTACCGCACAGAAATTGACAAACCATCCCAGCACCA TCACCACCACCAC (SEQ ID NO: 200) |
| 2382C09 | MGVSDVPRDLEVVAATPTSLLI SWDAPAEGYGYYRITYGETGGN SPVQEFTVPVSKGTATISGLKP GVDYTITVYAVEFDFPGSGYYH RPISINYRTEIDKPSQHHHHHH (SEQ ID NO: 201) | ATGGGAGTTTCTGATGTGCCGCGCGACCTGGAAGTGGTTGCTGCCACCCCCACCAGCCTGCTGA TCAGCTGGGACGCTCCGGCTGAGGGTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGCTCCGGTT ACTACCATCGTCCAATTTCCATTAATTACCGCACAGAAATTGACAAACCATCCCAGCACCATCA CCACCACCAC (SEQ ID NO: 202) |
| 2382D03 | MGVSDVPRDLEVVAATPTSLLI SWDAPADEAYGYYRITYGETGG NSPVQEFTVPVSKGTATISGLK PGVDYTITVYAVEFDFPGAGYY HRPISINYRTEIDKPSQHHHHH H (SEQ ID NO: 203) | ATGGGAGTTTCTGATGTGCCGCGCGACCTGGAAGTGGTTGCTGCCACCCCCACCAGCCTGCTGA TCAGCTGGGACGCTCCGGCTGACGAGGCGTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGTGTTGATTATACCATCACTGTGTATGCTGTCGAATTCGACTTCCCCGGCGCCG GTTACTACCATCGTCCAATTTCCATTAATTACCGCACAGAAATTGACAAACCATCCCAGCACCA TCACCACCACCAC (SEQ ID NO: 204) |
| 2382D05 | MGVSDVPRDLEVVAATPTSLLI SWDAPADGGYGYYRITYGETGG NSPVQEFTVPVSKGTATISGLK PGVDYTITVYAVEFDFPGAGYY HRPISINYRTEIDKPSQHHHHH H (SEQ ID NO: 205) | ATGGGAGTTTCTGATGTGCCGCGCGACCTGGAAGTGGTTGCTGCCACCCCCACCAGCCTGCTGA TCAGCTGGGACGCTCCGGCTGATGGTGGTTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCGACTTCCCCGGCGCCG GTTACTACCATCGTCCAATTTCCATTAATTACCGCACAGAAATTGACAAACCATCCCAGCACCA TCACCACCACCAC (SEQ ID NO: 206) |
| 2382D08 | MGVSDVPRDLEVVAATPTSLLI SWDAPADGYGYYRITYGETGGN SPVQEFTVPVSKGTATISGLKP GVDYTITVYAVEFPFPGSGYYH RPISINYRTEIDKPSQHHHHHH (SEQ ID NO: 207) | ATGGGAGTTTCTGATGTGCCGCGCGACCTGGAAGTGGTTGCTGCCACCCCCACCAGCCTGCTGA TCAGCTGGGACGCTCCGGCTGATGGCTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCCCCTTCCCCGGCTCCGGTT ACTACCATCGTCCAATTTCCATTAATTACCGCACAGAAATTGACAAACCATCCCAGCACCATCA CCACCACCAC (SEQ ID NO: 208) |
| 2382D09 | MGVSDVPRDLEVVAATPTSLLI SWDAPAEGYGYYRITYGETGGN SPVQEFTVPVSKGTATISGLKP GVDYTITVYAVEFDFPGAGYYH RPISINYRTEIDKPSQHHHHHH (SEQ ID NO: 209) | ATGGGAGTTTCTGATGTGCCGCGCGACCTGGAAGTGGTTGCTGCCACCCCCACCAGCCTGCTGA TCAGCTGGGACGCTCCGGCTGAAGGGTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGCGCCGGTT ACTACCATCGTCCAATTTCCATTAATTACCGCACAGAAATTGACAAACCATCCCAGCACCATCA CCACCACCAC (SEQ ID NO: 210) |
| 2382F02 | MGVSDVPRDLEVVAATPTSLLI SWDAPAGGYGYYRITYGETGG NSPVQEFTVPVSKGTATISGLK PGVDYTITVYAVEFDFPGSGYY | ATGGGAGTTTCTGATGTGCCGCGCGACCTGGAAGTGGTTGCTGCCACCCCCACCAGCCTGCTGA TCAGCTGGGACGCTCCGGCTGGCGGGGGGTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCGACTTCCCCGGGCTCCG |

TABLE 4-continued

Anti-PCSK9 Adnectin Family

| Clone | Amino Acid | Nucleic Acid |
|---|---|---|
| | HRPISINYRTEIDKPSQHHHHH H (SEQ ID NO: 211) | GTTACTACCATCGTCCAATTTCCATTAATTACCGCACAGAAATTGACAAACCATCCCAGCACCA TCACCACCACCAC (SEQ ID NO: 212) |
| 2382F03 | MGVSDVPRDLEVVAATPTSLLI SWDAPAADAYGYYRITYGETGG NSPVQEFTVPVSKGTATISGLK PGVDYTITVYAVEFNFPGAGYY HRPISINYRTEIDKPSQHHHHH H (SEQ ID NO: 213) | ATGGGAGTTTCTGATGTGCCGCGCGACCTGGAAGTGGTTGCTGCCACCCCCACCAGCCTGCTGA TCAGCTGGGACGCTCCGGCTGCCGATGCTTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCAACTTCCCGGGCGCCG GTTACTACCATCGTCCAATTTCCATTAATTACCGCACAGAAATTGACAAACCATCCCAGCACCA TCACCACCACCAC (SEQ ID NO: 214) |
| 2382F05 | MGVSDVPRDLEVVAATPTSLLI SWDAPAEEAGKHYGYYRITYGET GGNSPVQEFTVPVSKGTATISG LKPGVDYTITVYAVEFDFPGAG YYHRPISINYRTEIDKPSQHHH HHH (SEQ ID NO: 215) | ATGGGAGTTTCTGATGTGCCGCGCGACCTGGAAGTGGTTGCTGCCACCCCCACCAGCCTGCTGA TCAGCTGGGACGCTCCGGCTGAAGCAGGTAAGCACTACGGTTATTACCGCATCACTTACGGCGA AACAGGAGGCAATAGCCCTGTCCAGGAGTTCACTGTGCCTGTTTCTAAAGGTACAGCTACCATC AGCGGCCTTAAACCTGGCGTTGATTATACCATCACTGTGTATGCTGTCGAATTCGACTTCCCGG GCGCCGGTTACTACCATCGTCCAATTTCCATTAATTACCGCACAGAAATTGACAAACCATCCCA GCACCATCACCACCACCAC (SEQ ID NO: 216) |
| 2382F08 | MGVSDVPRDLEVVAATPTSLLI SWDAPAEAYGYYRITYGETGGN SPVQEFTVPVSKGTATISGLKP GVDYTITVYAVEFTYPGSGYYH RPISINYRTEIDKPSQHHHHHH (SEQ ID NO: 217) | ATGGGAGTTTCTGATGTGCCGCGCGACCTGGAAGTGGTTGCTGCCACCCCCACCAGCCTGCTGA TCAGCTGGGACGCTCCGGCTGAAGCATACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCACCTACCCCGGCTCCGGTT ACTACCATCGTCCAATTTCCATTAATTACCGCACAGAAATTGACAAACCATCCCAGCACCATCA CCACCACCAC (SEQ ID NO: 218) |
| 2382F09 | MGVSDVPRDLEVVAATPTSLLI SWDAPAAYGYYRITYGETGGN SPVQEFTVPVSKGTATISGLKP GVDYTITVYAVEYDFPGSGYYH RPISINYRTEIDKPSQHHHHHH (SEQ ID NO: 219) | ATGGGAGTTTCTGATGTGCCGCGCGACCTGGAAGTGGTTGCTGCCACCCCCACCAGCCTGCTGA TCAGCTGGGACGCTCCGGCTGCAGCCTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATACGACTTCCCCGGCTCCGGTT ACTACCATCGTCCAATTTCCATTAATTACCGCACAGAAATTGACAAACCATCCCAGCACCATCA CCACCACCAC (SEQ ID NO: 220) |
| 2382G04 | MGVSDVPRDLEVVAATPTSLLI SWDAPAGGGYGYYRITYGETGG NSPVQEFTVPSSKGTATISGLK PGVDYTITVYAVEFDFPGAGYY HRPISINYRTEIDKPSQHHHHH H (SEQ ID NO: 221) | ATGGGAGTTTCTGATGTGCCGCGCGACCTGGAAGTGGTTGCTGCCACCCCCACCAGCCTGCTGA TCAGCTGGGACGCTCCGGCTGGTGGGGGATACGGTTATTACCGCATCACTTACGGCGAAACAGG AGGCAATAGCCCTGTCCAGGAGTTCACTGTGCCTAGTTCAAAGGTACAGCTACCATCAGCGGC CTTAAACCTGGCGTTGATTATACCATCACTGTGTATGCTGTCGAATTCGACTTCCCGGGCGCCG GTTACTACCATCGTCCAATTTCCATTAATTACCGCACAGAAATTGACAAACCATCCCAGCACCA TCACCACCACCAC (SEQ ID NO: 222) |
| 2382H10 | MGVSDVPRDLEVVAATPTSLLI SWDAPAGGYGYYRITYGETGGN SPVQEFTVPVSKGTATISGLKP GVDYTITVYAVEFDFPGSGYYH RPISINYRTEIDKPSQHHHHHH (SEQ ID NO: 223) | ATGGGAGTTTCTGATGTGCCGCGCGACCTGGAAGTGGTTGCTGCCACCCCCACCAGCCTGCTGA TCAGCTGGGACGCTCCGGCTGGGGGCTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGCTCCGGTT ACTACCATCGTCCAATTTCCATTAATTACCGCACAGAAATTGACAAACCATCCCAGCACCATCA CCACCACCAC (SEQ ID NO: 224) |
| 2382H11 | MGVSDVPRDLEVVAATPTSLLI SWDAPADGYGYYRITYGETGGN SPVQEFTVPVFKGTATISGLKP GVDYTITVYAVEFDYPGSGYYH RPISINYRTEIDKPSQHHHHHH (SEQ ID NO: 225) | ATGGGAGTTTCTGATGTGCCGCGCGACCTGGAAGTGGTTGCTGCCACCCCCACCAGCCTGCTGA TCAGCTGGGACGCTCCGGCTGATGGTTACGGTTATTACCGCATCACTTACGGCGAAACAGGAGG CAATAGCCCTGTCCAGGAGTTCACTGTGCCTGTTTTTAAAGGTACAGCTACCATCAGCGGCCTT AAACCTGGCGTTGATTATACCATCACTGTGTATGCTGTCGAATTCGACTACCCCGGCTCCGGTT ACTACCATCGTCCAATTTCCATTAATTACCGCACAGAAATTGACAAACCATCCCAGCACCATCA CCACCACCAC (SEQ ID NO: 226) |
| 2382H04 | MGVSDVPRDLEVVAATPTSLLI SWDAPAAGGYGYYRITYGETGG NSPVQEFTVPSSKGTATISGLK PGVDYTITVYAVEYDFPGAGYY HRPISINYRTEIDKPSQHHHHH H (SEQ ID NO: 227) | ATGGGAGTTTCTGATGTGCCGCGCGACCTGGAAGTGGTTGCTGCCACCCCCACCAGCCTGCTGA TCAGCTGGGACGCTCCGGCTGCGGGGGGTACGGTTATTACCGCATCACTTACGGCGAAACAGG AGGCAATAGCCCTGTCCAGGAGTTCACTGTGCCTAGTTCAAAGGTACAGCTACCATCAGCGGC CTTAAACCTGGCGTTGATTATACCATCACTGTATATGCTGTCGAATACGACTTCCCCGGCGCCG GTTACTACCATCGTCCAATTTCCATTAATTACCGCACAGAAATTGACAAACCATCCCAGCACCA TCACCACCACCAC (SEQ ID NO: 228) |
| 2382H07 | MGVSDVPRDLEVVAATPTSLLI SWDAPADAYGYYRITYGETGGN SPVQEFTVPGSKGTATISGLKP GVDYTITVYAVEFDFPGSGYYH RPISINYRTEIDKPSQHHHHHH (SEQ ID NO: 229) | ATGGGAGTTTCTGATGTGCCGCGCGACCTGGAAGTGGTTGCTGCCACCCCCACCAGCCTGCTGA TCAGCTGGGACGCTCCGGCTGATGCTTATTACCGCATCACTTACGGCGAAACAGGAGG CAATAGCCCAGTCCAGGAGTTCACTGTGCCTGGTTCTAAAGGTACAGCTACCATCAGCGGCCTT AAACCTGGCGTTGATTATACCATCACTGTGTATGCTGTCGAATTCGACTTCCCCGGCTCCGGTT ACTACCATCGTCCAATTTCCATTAATTACCGCACAGAAATTGACAAACCATCCCAGCACCATCA CCACCACCAC (SEQ ID NO: 230) |
| 2382H09 | MGVSDVPRDLEVVAATPTSLLI SWDAPAAYGYYRITYGETGGN SPVQEFTVPSSKGTATISGLKP GVDYTITVYAVEFDFPGSGYYH RPISINYRTEIDKPSQHHHHHH (SEQ ID NO: 231) | ATGGGAGTTTCTGATGTGCCGCGCGACCTGGAAGTGGTTGCTGCCACCCCCACCAGCCTGCTGA TCAGCTGGGACGCTCCGGCTGCGGCTTACGGTTATTACCGCATCACTTACGGCGAAACAGGAGG CAATAGCCCTGTCCAGGAGTTCACTGTGCCTAGTTCTAAAGGTACAGCTACCATCAGCGGCCTT AAACCTGGCGTTGATTATACCATCACTGTGTATGCTGTCGAATTCGACTTCCCCGGCTCCGGTT ACTACCATCGCCCAATTTCCATTAATTACCGCACAGAAATTGACAAACCATCCCAGCACCATCA CCACCACCAC (SEQ ID NO: 232) |

TABLE 4-continued

Anti-PCSK9 Adnectin Family

| Clone | Amino Acid | Nucleic Acid |
|---|---|---|
| 2451A02 | MGVSDVPRDLEVVAATPTSLLI SWDAPAAGYGYYRITYGETGGN SPVQEFTVPVSKGTATISGLKP GVDYTITVYAVEFPFPGSGYYH RPISINYRTEIDKPSQHHHHHH (SEQ ID NO: 233) | ATGGGAGTTTCTGATGTGCCGCGCGACCTGGAAGTGGTTGCTGCCACCCCCACCAGCCTGCTGA TCAGCTGGGACGCTCCGGCTGCGGGTTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCCCCTTCCCCGGCTCCGGTT ACTACCATCGTCCAATTTCCATTAATTACCGCACAGAAATTGACAAACCATCCCAGCACCATCA CCACCACCAC (SEQ ID NO: 234) |
| 2451B05 | MGVSDVPRDLEVVAATPTSLLI SWDAPAGGYGYYRITYGETGGN SPVQEFTVPSSKGTATISGLKP GVDYTITVYAVEFDYPGSGYYH RPISINYRTEIDKPSQHHHHHH (SEQ ID NO: 235) | ATGGGAGTTTCTGATGTGCCGCGCGACCTGGAAGTGGTTGCTGCCACCCCCACCAGCCTGCTGA TCAGCTGGGACGCTCCGGCTGGGGGATACGGTTATTACCGCATCACTTACGGCGAAACAGGAGG CAATAGCCCTGTCCAAGGAGTTCACTGTGCCTAGTTCTAAAGGTACAGCTACCATCAGCGGCCTT AAACCTGGCGTTGATTATACCATCACTGTGTATGCTGTCGAATTCGACTACCCCGGCTCCGGTT ACTACCATCGTCCAATTTCCATTAATTACCGCACAGAAATTGACAAACCATCCCAGCACCATCA CCACCACCAC (SEQ ID NO: 236) |
| 2451B06 (equivalent to 2382D05) | MGVSDVPRDLEVVAATPTSLLI SWDAPADGGYGYYRITYGETGG NSPVQEFTVPVSKGTATISGLK PGVDYTITVYAVEFDFPGAGYY HRPISINYRTEIDKPSQHHHHH H (SEQ ID NO: 205) | ATGGGAGTTTCTGATGTGCCGCGCGACCTGGAAGTGGTTGCTGCCACCCCCACCAGCCTGCTGA TCAGCTGGGACGCTCCGGCTGATGGTGGTTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCGACTTCCCGGGCGCCG GTTACTACCATCGTCCAATTTCCATTAATTACCGCACAGAAATTGACAAACCATCCCAGCACCA TCACCACCACCAC (SEQ ID NO: 206) |
| 2451C06 | MGVSDVPRDLEVVAATPTSLLI SWDAPAGAASYGYYRITYGETG GNSPVQEFTVPVSKGTATISGL KPGVDYTITVYAVEFPFPGAGY YHRPISINYRTEIDKPSQHHHH HH (SEQ ID NO: 237) | ATGGGAGTTTCTGATGTGCCGCGCGACCTGGAAGTGGTTGCTGCCACCCCCACCAGCCTGCTGA TCAGCTGGGACGCTCCGGCTGGGGCAGCGTCCTACGGTTATTACCGCATCACTTACGGCGAAAC AGGAGGCAATAGCCCTGTCCAGGAGTTCACTGTGCCTGTTTCTAAAGGTACAGCTACCATCAGC GGCCTTAAACCTGGCGTTGATTATACCATCACTGTGTATGCTGTCGAATTCCCCTTCCCCGGCG CCGGTTACTACCATCGTCCAATTTCCATTAATTACCGCACAGAAATTGACAAACCATCCCAGCA CCATCACCACCACCAC (SEQ ID NO: 238) |
| 2451D05 | MGVSDVPRDLEVVAATPTSLLI SWDAPAGAYGYYRITYGETGGN SPVQEFTVPVSKGTATISGLKP GVDYTITVYAVEFDFPGSGYYH RPISINYRTEIDKPSQHHHHHH (SEQ ID NO: 239) | ATGGGAGTTTCTGATGTGCCGCGCGACCTGGAAGTGGTTGCTGCCACCCCCACCAGCCTGCTGA TCAGCTGGGACGCTCCGGCTGGCGCGTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGCTCCGGTT ACTACCATCGTCCAATTTCCATTAATTACCGCACAGAAATTGACAAACCATCCCAGCACCATCA CCACCACCAC (SEQ ID NO: 240) |
| 2451F03 | MGVSDVPRDLEVVAATPTSLLI SWDPPAEGYGYYRITYGETGGN SPVQEFTVPVSKGTATISGLKP GVDYTITVYAVEFNFPGSGYYH RPISINYRTEIDKPSQHHHHHH (SEQ ID NO: 241) | ATGGGAGTTTCTGATGTGCCGCGCGACCTGGAAGTGGTTGCTGCCACCCCCACCAGCCTGCTGA TCAGCTGGGACCCTCCGGCTGAAGGTTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCAACTTCCCCGGCTCCGGTT ACTACCATCGTCCAATTTCCATTAATTACCGCACAGAAATTGACAAACCATCCCAGCACCATCA CCACCACCAC (SEQ ID NO: 242) |
| 2451G01 | MGVSDVPRDLEVVAATPTSLLI SWDAPAGGYGYYRITYGETGGN SPVQEFTVPSSKGTATISGLKP GVDYTITVYAVEFDFPGSGYYH RPISINYRTEIDKPSQHHHHHH (SEQ ID NO: 243) | ATGGGAGTTTCTGATGTGCCGCGCGACCTGGAAGTGGTTGCTGCCACCCCCACCAGCCTGCTGA TCAGCTGGGACGCTCCGGCTGGGGGCTACGGTTATTACCGCATCACTTACGGCGAAACAGGAGG CAATAGCCCTGTCCAGGAGTTCACTGTGCCTAGTTCTAAAGGTACAGCTACCATCAGCGGCCTT AAACCTGGCGTTGATTATACCATCACTGTGTATGCTGTCGAATTCGACTTCCCGGGCTCCGGTT ACTACCATCGTCCAATTTCCATTAATTACCGCACAGAAATTGACAAACCATCCCAGCACCATCA CCACCACCAC (SEQ ID NO: 244) |
| 2451H07 | MGITDVPRDLEVVAATPTSLLI SWNPPDVNYGYYRITYGETGGN SPLQEFTVPVSKGTATISGLKP GVDYTITVYAVEYPYAHAGYYH RPISINYRTEIDKPSQHHHHHH (SEQ ID NO: 245) | ATGGGTATCACGGATGTGCCGCGAGACTTGGAAGTGGTTGCTGCCACCCCCACCAGCCTGCTGA TCAGCTGGAACCCGCCGGATGTGAATTACGGTTACTACCGCATCACTTACGGGGAAACAGGAGG CAATAGCCCTTTGCAGGAGTTCACTGTGCCTGTTTCTAAAGGTACAGCTACCATCAGCGGCCTT AAACCTGGCGTTGATTATACCATCACTGTGTATGCTGTCGAATATCCGTACGCGCACGCTGGTT ACTACCATCGTCCGATTTCCATTAATTACCGCACAGAAATTGACAAACCATCCCAGCACCATCA CCACCACCAC (SEQ ID NO: 246) |
| 2382E03 | MGVSDVPRDLEVVAATPTSLLI SWDAPAGDGYGYYRITYGETGG NSPVQEFTVPVSKGTATISGLK PGVDYTITVYAVEFDFPGSGYY HRPISINYRTEIDKPSQHHHHH H (SEQ ID NO: 247) | ATGGGAGTTTCTGATGTGCCGCGCGACCTGGAAGTGGTTGCTGCCACCCCCACCAGCCTGCTGA TCAGCTGGGACGCTCCGGCTGGGGACGGGTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCGACTTCCCCGGCGCCG GTTACTACCATCGTCCAATTTCCATTAATTACCGCACAGAAATTGACAAACCATCCCAGCACCA TCACCACCACCAC (SEQ ID NO: 248) |
| 2382E04 | MGVSDVPRDLEVVAATPTSLLI SWDAPAGGGYGYYRITYGETGG NSPVQEFTVPVSKGTATISGLK PGVDYTITVYAVEFTFPGAGYY HRPISINYRTEIDKPSQHHHHH H (SEQ ID NO: 249) | ATGGGAGTTTCTGATGTGCCGCGCGACCTGGAAGTGGTTGCTGCCACCCCCACCAGCCTGCTGA TCAGCTGGGACGCTCCGGCTGGTGGTGGATACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCACCTTCCCGGGCGCCG GTTACTACCATCGTCCAATTTCCATTAATTACCGCACAGAAATTGACAAACCATCCCAGCACCA TCACCACCACCAC (SEQ ID NO: 250) |
| 2382E05 | MGVSDVPRDLEVVAATPTSLLI SWDAPAEGGYGYYRITYGETGG NSPVQEFTVPVSKGTATISGLK | ATGGGAGTTTCTGATGTGCCGCGCGACCTGGAAGTGGTTGCTGCCACCCCCACCAGCCTGCTGA TCAGCTGGGACGCTCCGGCTGAGGGCGGCTACGGTTATTACCGCATCACTTACGGCGAAACAGG AGGCAATAGCCCTGTCCAGGAGTTCACTGTGCCTGTTTCTAAAGGTACAGCTACCATCAGCGGC |

TABLE 4-continued

Anti-PCSK9 Adnectin Family

| Clone | Amino Acid | Nucleic Acid |
|---|---|---|
| | PGVDYTITVYAVEFDFPGAGYY HRPISINYRTEIDKPSQHHHH H (SEQ ID NO: 251) | CTTAAACCTGGCGTTGATTATACCATCACTGTGTATGCTGTCGAATTCGACTTCCCCGGCGCCG GTTACTACCATCGTCCAATTTCCATTAATTACCGCACAGAAATTGACAAACCATCCCAGCACCA TCACCACCACCAC (SEQ ID NO: 252) |
| 2382E09 | MGVSDVPRDLEVVAATPTSLLI SWDAPAEAYGYYRITYGETGGN SPVQEFTVPVSKGTATISGLKP GVDYTITVYAVEYDFPGSGYYH RPISINYRTEIDKPSQHHHHHH (SEQ ID NO: 253) | ATGGGAGTTTCTGATGTGCCGCGCGACCTGGAAGTGGTTGCTGCCACCCCCACCAGCCTGCTGA TCAGCTGGGACGCTCCGGCTGAGGCTTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATACGACTTCCCCGGCTCCGGTT ACTACCATCGTCCAATTTCCATTAATTACCGCACAGAAATTGACAAACCATCCCAGCACCATCA CCACCACCAC (SEQ ID NO: 254) |
| 2381A04 | MGVSDVPRDLEVVAATPTSLLI SWEPFSRLPGGGEYYRITYGET GGNSPLQQFTVPGSKGTATISG LKPGVDYTITVYAVEYPYPFSG YYHRPISINYRTEIDKPSQHHH HHH (SEQ ID NO: 255) | ATGGGAGTTTCTGATGTGCCGCGCGACCTGGAAGTGGTTGCTGCCACCCCCACCAGCCTGCTGA TCAGCTGGGAGCCGTTCAGCCGGTTGCCCGGGGGCGGCGAGTATTACCGGATCACTTACGGCGA AACAGGAGGCAATAGCCCTCTGCAGCAGTTCACTGTGCCTGGTTCTAAAGGTACAGCTACCATC AGCGGCCTTAAACCTGGCGTTGATTATACCATCACTGTGTATGCTGTCGAATACCCGTACCCGT TTTCTGGTTACTACCATCGTCCCATTTCCATTAATTACCGCACAGAAATTGACAAACCATCCCA GCACCATCACCACCACCAC (SEQ ID NO: 256) |
| 2381A08 | MGVSDVPRDLEVVAATPTSLLI SWDAPADGGYGYYRITYGETGG NSPVQEFTVPVSKGTATISGLK PGVDYTITVYAVEYDFPGAGYY HRPISINYRTEIDKPSQHHHHH H (SEQ ID NO: 257) | ATGGGAGTTTCTGATGTGCCGCGCGACCTGGAAGTGGTTGCTGCCACCCCCACCAGCCTGCTGA TCAGCTGGGACGCTCCGGCTGACGGCGGGTACGGTTATTACCGCATCACTTACGGCGAAACAGG AGGCAATAGCCCTGTCCAGGAGTTCACTGTGCCTGGTTCTAAAGGTACAGCTACCATCAGCGGC CTTAAACCTGGCGTTGATTATACCATCACTGTGTATGCTGTCGAATACGACTTCCCGGGCGCCG GTTACTACCATCGTCCAATTTCCATTAATTACCGCACAGAAATTGACAAACCATCCCAGCACCA TCACCACCACCAC (SEQ ID NO: 258) |
| 2381B10 | MGVSDVPRDLEVVAATPTSLLI SWDAPAGGGYGYYRITYGETGG NSPVQEFTVPVSKGTATISGLK PGVDYTITVYAVEYNFIGAGYY HRPISINYRTEIDKPSQHHHHH H (SEQ ID NO: 259) | ATGGGAGTTTCTGATGTGCCGCGCGACCTGGAAGTGGTTGCTGCCACCCCCACCAGCCTGCTGA TCAGCTGGGACGCTCCGGCTGGGGGTGGATACGGTTATTACCGGATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATACAACTTCATCGGCGCCG GTTACTACCATCGTCCAATTTCCATTAATTACCGCACAGAAATTGACAAACCATCCCAGCACCA TCACCACCACCAC (SEQ ID NO: 260) |
| 2381C08 | MGVSDVPRDLEVVAATPTSLLI SWDAPADGAYGYYRITYGETGG NSPVQEFTVPVSKGTATISGLK PGVDYTITVYAVEFPYPPFAGYY HRPISINYRTEIDKPSQHHHHH H (SEQ ID NO: 261) | ATGGGAGTTTCTGATGTGCCGCGCGACCTGGAAGTGGTTGCTGCCACCCCCACCAGCCTGCTGA TCAGCTGGGACGCTCCGGCTGACGGTGCCTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCGTGTATGCTGTCGAATTCCCCTACCCCTTCGCCG GTTACTACCATCGTCCAATTTCCATTAATTACCGCACAGAAATTGACAAACCATCCCAGCACCA TCACCACCAC (SEQ ID NO: 262) |
| 2381G06 | MGVSDVPRDLEVVAATPTSLLI SWSEKLDGKARRGYYRITYGET GGNSPVQQFTVPGSKGTATISG LKPGVDYTITVYAVEFPYDHSG YYHRPISINYRTEIDKPSQHHH HHH (SEQ ID NO: 263) | ATGGGAGTTTCTGATGTGCCGCGCGACCTGGAAGTGGTTGCTGCCACCCCCACCAGCCTGCTGA TCAGCTGGTCGGAGAAGTTGGACGGGAAGGCGCGCCGCGGGTATTACCGCATCACATACGGCGA AACAGGAGGCAATAGCCCTGTCCAGCAGTTCACTGTGCCTGGTTCTAAAGGTACAGCTACCATC AGCGGCCTTAAACCTGGCGTTGATTATACCATCACTGTGTATGCTGTCGAATTCCCGTACGACC ATTCTGGTTACTACCATCGTCCCATTTCCATTAATTACCGCACAGAAATTGACAAACCATCCCA GCACCATCACCACCACCAC (SEQ ID NO: 264) |
| 2381H01 | MGVSDVPRDLEVVAATPTSLLI SWSPRDSTGLVRRGYYRITYGE TGGNSPVQQFTVPGSKGTATIS GLKPGVDYTITVYAVEYPYDHS GYYHRPISINYRTEIDKPSQHH HHHH (SEQ ID NO: 265) | ATGGGAGTTTCTGATGTGCCGCGCGACCTGGAAGTGGTTGCTGCCACCCCCACCAGCCTGCTGA TCAGCTGGAGCCCGCGGGACTCCACCGGCTTGGTGAGGCGGGGTATTACCGCATCACTTACGG TGGGAACAGGAGGCAATAGCCCTGTTCAGCAGTTCACTGTGCCTGGTTCTAAAGGTACAGCTACC ATCAGCGGCCTTAAACCTGGCGTTGATTATACCATCACTGTGTATGCTGTCGAATACCCGTACG ACCATTCTGGTTACTACCATCGGCCCATTTCCATTAATTACCGCACAGAAATTGACAAACCATC CCAGCACCATCACCACCACCAC (SEQ ID NO: 266) |
| 2381H06 | MGVSDVPRDLEVVAATPTSLLI SWGDVRTNEARQGYYRITYGET GGNSPLQGFTVPGSKGTATISG LKPGVDYTITVYAVEYTYEHSG YYHRPISINYRTEIDKPSQHHH HHH (SEQ ID NO: 267) | ATGGGAGTTTCTGATGTGCCGCGCGACCTGGAAGTGGTTGCTGCCACCCCCACCAGCCTGCTGA TCAGCTGGGGCGACGTCCGGACGAACGAGGCGCGGCAGGGCTATTACCGGATCACTTACGGCGA AACAGGAGGCAATAGCCCTCTCCAGGGGTTCACTGTGCCTGGTTCTAAAGGTACAGCTACCATC AGCGGCCTTAAACCTGGCGTTGATTATACCATCACTGTGTATGCTGTCGAGTATACGTACGAGC ATTCTGGTTACTACCATCGTCCGATTTCCATTAATTACCGCACAGAAATTGACAAACCATCCCA GCACCATCACCACCACCAC (SEQ ID NO: 268) |
| 2381H09 | MGVSDVPRDLEVVAATPTSLLI SWDAPAGGGYGYYRITYGETGG NSPVQEFTVPVSKGTATISGLK PGVDYTITVYAVEFDFVGAGYY HRPISINYRTEIDKPSQHHHHH H (SEQ ID NO: 269) | ATGGGAGTTTCTGATGTGCCGCGCGACCTGGAAGTGGTTGCTGCCACCCCCACCAGCCTGCTGA TCAGCTGGGACGCTCCGGCTGGGGGGGCTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATTCGACTTCGTCGGCGCCG GTTACTACCATCGTCCAATTTCCATTAATTACCGCACAGAAATTGACAAACCATCCCAGCACCA TCACCACCACCAC (SEQ ID NO: 270) |
| 2382B11 | MGVSDVPRDLEVVAATPTSLLI SWDAPAAAYGYYRITYGETGGN SPVQEFTVPSKGTATISGLKPG VDYTITVYAVEYDFAGSGYYH RPISINYRTEIDKPSQHHHHHH (SEQ ID NO: 271) | ATGGGAGTTTCTGATGTGCCGCGCGACCTGGAAGTGGTTGCTGCCACCCCCACCAGCCTGCTGA TCAGCTGGGACGCTCCGGCTGCGGCCTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATACGACTTCGCGGGCTCCGGTT ACTACCATCGTCCAATTTCCATTAATTACCGCACAGAAATTGACAAACCATCCCAGCACCATCA CCACCACCAC (SEQ ID NO: 272) |

TABLE 4-continued

Anti-PCSK9 Adnectin Family

| Clone | Amino Acid | Nucleic Acid |
|---|---|---|
| 2382B08 | MGVSDVPRDLEVVAATPTSLLI SWDAPADAYGYYRITYGETGGN SPVQEFTVPSSKGTATISGLKP GVDYTITVYAVEFAFPGAGYYH RPISINYRTEIDKPSQHHHHHH (SEQ ID NO: 273) | ATGGGAGTTTCTGATGTGCCGCGCGACCTGGAAGTGGTTGCTGCCACCCCCACCAGCCTGCTGA TCAGCTGGGACGCTCCGGCTGACGCGTACGGTTATTACCGCATCACTTACGGCGAAACAGGAGG CAATAGCCCTGTCCAGGAGTTCACTGTGCCTAGTTCTAAAGGTACAGCTACCATCAGCGGCCTT AAACCTGGCGTTGATTATACCATCACTGTGTATGCTGTCGAATTCGCCTTCCCCGGCGCCGGTT ACTACCATCGTCCAATTTCCATTAATTACCGCACAGAAATTGACAAACCATCCCAGCACCATCA CCACCACCAC (SEQ ID NO: 274) |
| 2382C11 | MGVSDVPRDLEVVAATPTSLLI SWDAPAGGYGYYRITYGETGGN SPVQEFTVPVSKGTATISGLKP GVDYTITVYAVEYDFAGSGYYH RPISINYRTEIDKPSQHHHHHH (SEQ ID NO: 275) | ATGGGAGTTTCTGATGTGCCGCGCGACCTGGAAGTGGTTGCTGCCACCCCCACCAGCCTGCTGA TCAGCTGGGACGCTCCGGCTGGAGGTTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATACGACTTCGCGGGCTCCGGTT ACTACCATCGTCCAATTTCCATTAATTACCGCACAGAAATTGACAAACCATCCCAGCACCATCA CCACCACCAC (SEQ ID NO: 276) |
| 2382G03 | MGVSDVPRDLEVVAATPTSLLI SWDAPAEAEAYGYYRITYGETG GNSPVQEFTVPVSKGTATISGL KPGVDYTITVYAVEYVFPGAGY YHRPISINYRTEIDKPSQHHHH HH (SEQ ID NO: 277) | ATGGGAGTTTCTGATGTGCCGCGCGACCTGGAAGTGGTTGCTGCCACCCCCACCAGCCTGCTGA TCAGCTGGGACGCTCCGGCTGAAGCAGAAGCGTACGGTTATTACCGCATCACTTACGGCGAAAC AGGAGGCAATAGCCCTGTCCAGGAGTTCACTGTGCCTGTTTCTAAAGGTACAGCTACCATCAGC GGCCTTAAACCTGGCGTTGATTATACCATCACTGTGTATGCTGTCGAATACGTCTTCCCCGGCG CCGGTTACTACCATCGTCCAATTTCCATTAATTACCGCACAGAAATTGACAAACCATCCCAGCA CCATCACCACCACCAC (SEQ ID NO: 278) |
| 2382H03 | MGVSDVPRDLEVVAATPTSLLI SWDAPAEGAYGYYRITYGETGG NSPVQEFTVPVSKGTATISGLK PGVDYTITVYAVEYPYPPAGYY HRPISINYRTEIDKPSQHHHHH H (SEQ ID NO: 279) | ATGGGAGTTTCTGATGTGCCGCGCGACCTGGAAGTGGTTGCTGCCACCCCCACCAGCCTGCTGA TCAGCTGGGACGCTCCGGCTGAGGGCGCTTACGGTTATTACCGCATCACTTACGGCGAAACAGG AGGCAATAGCCCTGTCCAGGAGTTCACTGTGCCTGTTTCTAAAGGTACAGCTACCATCAGCGGC CTTAAACCTGGCGTTGATTATACCATCACTGTGTATGCTGTCGAATACCCCTACCCCTTCGCCG GTTACTACCATCGTCCAATTTCCATTAATTACCGCACAGAAATTGACAAACCATCCCAGCACCA TCACCACCACCAC (SEQ ID NO: 280) |
| 2451A10 | MGVTDVPRDMEVVAATPTSLLI SWQPPAVTYGYYRITYGETGGN STLQQFTVPVYKGTATISGLKP GVDYTITVYAVEYPYDHSGYYH RPISINYRTEIDKPSQHHHHHH (SEQ ID NO: 281) | ATGGGTGTCACCGATGTGCCGCGCGACATGGAAGTGGTTGCTGCCACCCCCACCAGCCTGCTGA TCAGCTGGCAGCCGCCGGCTGTTACTTACGGTTATTATCGCATCACTTACGGCGAAACAGGAGG CAATAGCACTCTCCAGCAGTTCACTGTGCCTGTTTATAAAGGTACAGCTACCATCAGCGGCCTT AAACCTGGCGTTGATTATACCATCACTGTGTATGCTGTCGAATACCCGTACGACCATTCTGGGT ACTACCATCGGCCGATTTCCATTAATTACCGCACAGAAATTGACAAACCATCCCAGCACCATCA CCACCACCAC (SEQ ID NO: 282) |
| 2451B02 | MGVSDVPRDLEVVAATPTSLLI SWDAPAAAYGYYRITYGETGGN SPVQEFTVPVSKGTATISGLKP GVDYTITVYAVEFDYPGSGYYH RPISINYRTEIDKPSQHHHHHH (SEQ ID NO: 283) | ATGGGAGTTTCTGATGTGCCGCGCGACCTGGAAGTGGTTGCTGCCACCCCCACCAGCCTGCTGA TCAGCTGGGACGCTCCGGCTGCTGCTTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTACCCCGGCTCCGGTT ACTACCATCGTCCAATTTCCATTAATTACCGCACAGAAATTGACAAACCATCCCAGCACCATCA CCACCACCAC (SEQ ID NO: 284) |
| 2451C11 | MGIVDVPRDLVVVAATPTSLLI SWDPPAGAYGYYRITYGETGGN SPKQQFTVPGYKGTATISGLKP GVDYTITVYAVEYPYDHSGYYH RPISINYRTEIDKPSQHHHHHH (SEQ ID NO: 285) | ATGGGTATCGTGGATGTGCCGCGCGACCTGGAAGTGGTTGCTGCCACCCCCACCAGCCTGCTGA TCAGCTGGGACCCGCCGGCTGGTGCTTACGGTTATTACCGCATCACTTACGGCGAAACAGGAGG CAATAGCCCAAAGCAGCAGTTCACTGTGCCTGGTTATAAAGGTACAGCTACCATCAGCGGCCTT AAACCTGGCGTTGATTATACCATCACTGTGTATGCTGTCGAATACCCGTACGACCATTCTGGTT ACTACCATCGGCCGATTTCCATTAATTACCGCACAGAAATTGACAAACCATCCCAGCACCATCA CCACCACCAC (SEQ ID NO: 286) |
| 2451H01 | MGVSDVPRDLEVVAATPTSLLI SWDAPAAGYGYYRITYGETGGN SPVQEFTVPVSKGTATISGLKP GVDYTITVYAVEYDFPGSGYYH RPISINYRTEIDKPSQHHHHHH (SEQ ID NO: 287) | ATGGGAGTTTCTGATGTGCCGCGCGACCTGGAAGTGGTTGCTGCCACCCCCACCAGCCTGCTGA TCAGCTGGGACGCTCCGGCTGCGGGGTACGGTTATTACCGCATCACTTACGGCGAAACAGGAGG CAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATACGACTTCCCCGGCTCCGGTT ACTACCATCGTCCAATTTCCATTAATTACCGCACAGAAATTGACAAACCATCCCAGCACCATCA CCACCACCAC (SEQ ID NO: 288) |
| 2011B11 | MGVSDVPRDLEVVAATPTSLLI SWAPPSDAYGYYRITYGETGGN SPVQEFTVPIGKGTATISGLKP GVDYTITVYAVEYPYSHAGYYH RPISINYRTEIDKPSQHHHHHH (SEQ ID NO: 289) | ATGGGAGTTTCTGATGTGCCGCGCGACCTGGAAGTGGTTGCTGCCACCCCCACCAGCCTGCTGA TCAGCTGGGCGCCGCCTTCTGATGCGTACGGTTATTACCGCATCACTTACGGCGAAACAGGAGG CAATAGCCCTGTCCAGGAGTTCACTGTGCCTATTGGTAAAGGTACAGCTACCATCAGCGGCCTT AAACCTGGCGTTGATTATACCATCACTGTGTATGCTGTCGAATACCCGTATTCACATGCTGGTT ACTACCATCGTCCAATTTCCATTAATTACCGCACAGAAATTGACAAACCATCCCAGCACCATCA CCACCACCAC (SEQ ID NO: 290) |
| 2971A03 | MGVSDVPRDLEVVAATPTSLLI SWDPPSDDYGYYRITYGETGGN SPVQEFTVPIGKGTATISGLKP GVDYTITVYAVEFPWPHAGYYH RPISINYRTEIDKPSQHHHHHH (SEQ ID NO: 304) | ATGGGAGTTTCTGATGTGCCGCGCGACCTGGAAGTGGTTGCTGCCACCCCCACCAGCCTGCTGA TCAGCTGGGACCCGCCGTCTGATGATTACGGTTATTACCGCATCACTTACGGCGAAACAGGAGG CAATAGCCCTGTCCAGGAGTTCACTGTGCCTATTGGTAAAGGAACAGCTACCATCAGCGGCCTT AAACCTGGCGTTGATTATACCATCACTGTGTATGCTGTCGAGTTTCCGTGGCCACATGCTGGTT ACTATCATCGGCCAATTTCCATTAATTACCGCACAGAAATTGACAAACCATCCCAGCACCATCA CCACCACCAC (SEQ ID NO: 305) |
| 2971A09 | MGVSDVPRDLEVVAATPTSLLI SWDAPADDYGYYRITYGETGGN SPVQEFTVPIGKGTATISGLKP GVDYTITVYAVEFPWPHAGYYH | ATGGGAGTTTCTGATGTGCCGCGCGACCTGGAAGTGGTTGCTGCCACCCCCACCAGCCTGCTGA TCAGCTGGGACGCGCCTGCGGATGATTACGGTTATTACCGCATCACTTACGGCGAAACAGGAGG CAATAGCCCTGTCCAGGAGTTCACTGTGCCTATTGGTAAAGGAACAGCTACCATCAGCGGCCTT AAACCTGGCGTTGATTATACCATCACTGTGTATGCTGTCGAGTTTCCGTGGCCACATGCTGGTT |

TABLE 4-continued

Anti-PCSK9 Adnectin Family

| Clone | Sequence Amino Acid | Nucleic Acid |
|---|---|---|
|  | RPISINYRTEIDKPSQHHHHHH (SEQ ID NO: 306) | ACTATCATCGGCCAATTTCCATTAATTACCGCACAGAAATTGACAAACCATCCCAGCACCATCA CCACCACCAC (SEQ ID NO: 307) |
| 2971E02 | MGVSDVPRDLEVVAATPTSLLI SWDAPSDDYGYYRITYGETGGN SPVQEFTVPIGKGTATISGLKP GVDYTITVYAVEFPWPHAGYYH RPISINYRTEIDKPSQHHHHHH (SEQ ID NO: 308) | ATGGGAGTTTCTGATGTGCCGCGCGACCTGGAAGTGGTTGCTGCCACCCCCACCAGCCTGCTGA TCAGCTGGGACGCGCCTTCGGATGATTACGGTTATTACCGCATCACTTACGGCGAAACAGGAGG CAATAGCCCTGTCCAGGAGTTCACTGTGCCTATTGGTAAAGGAACAGCTACCATCAGCGGCCTT AAACCTGGCGTTGATTATACCATCACTGTGTATGCTGTCGAGTTTCCGTGGCCACATGCTGGTT ACTATCATCGGCCAATTTCCATTAATTACCGCACAGAAATTGACAAACCATCCCAGCACCATCA CCACCACCAC (SEQ ID NO: 309) |

The SEQ ID NOS of the family of the pegylated anti-PCSK9 Adnectins of the invention are presented in Table 5.

TABLE 5

Anti-PCSK9 Adnectin Family Cysteine Mutants to Enable Pegylation

| ATI#/Clone# [Description] | Sequence AA | NT |
|---|---|---|
| ATI001170 [2013E01-non His tagged Cys mut] | MGVSDVPRDLEVVAATPTSL LISWVPPSDDYGYYRITYGE TGGNSPVQEFTVPIGKGTAT ISGLKPGVDYTITVYAVEFP WPHAGYYHRPISINYRTEID KPCQ (SEQ ID NO: 78) | ATGGGAGTTTCTGATGTGCCGCGCGACCTGGAAGTGGTTGCTGCCACCCCCACCAGCCTGCTGAT CAGCTGGGTCCCGCCTTCAGATGATTACGGTTATTACCGCATCACTTACGGCGAAACAGGAGGCA ATAGCCCTGTCCAGGAGTTCACTGTGCCTATTGGTAAAGGAACAGCTACCATCAGCGGCCTTAAA CCTGGCGTTGATTATACCATCACTGTGTATGCTGTCGAGTTTCCGTGGCCACATGCTGGTTACTA TCATCGGCCAATTTCCATTAATTACCGCACAGAAATTGACAAACCATGCCAGTG (SEQ ID NO: 79) |
| ATI001172 [2013E01-non His tagged Cys mut] | MGVSDVPRDLEVVAATPTSL LISWVPPSDDYGYYRITYGE TGGNSPVQEFTVPIGKGTAT ISGLKPGVDYTITVYAVEFP WPHAGYYHRPISINYRTEGS GC (SEQ ID NO: 80) | ATGGGAGTTTCTGATGTGCCGCGCGACCTGGAAGTGGTTGCTGCCACCCCCACCAGCCTGCTGAT CAGCTGGGTCCCGCCTTCAGATGATTACGGTTATTACCGCATCACTTACGGCGAAACAGGAGGCA ATAGCCCTGTCCAGGAGTTCACTGTGCCTATTGGTAAAGGAACAGCTACCATCAGCGGCCTTAAA CCTGGCGTTGATTATACCATCACTGTGTATGCTGTCGAGTTTCCGTGGCCACATGCTGGTTACTA TCATCGGCCAATTTCCATTAATTACCGAACAGAAGGTAGCGGTTGCTG (SEQ ID NO: 81) |
| ATI001174* [2013E01-non His tagged Cys mut] also referred to as ATI-1174 | MGVSDVPRDLEVVAATPTSL LISWVPPSDDYGYYRITYGE TGGNSPVQEFTVPIGKGTAT ISGLKPGVDYTITVYAVEFP WPHAGYYHRPISINYRTEIE KPCQ (SEQ ID NO: 82) | ATGGGAGTTTCTGATGTGCCGCGCGACCTGGAAGTGGTTGCTGCCACCCCCACCAGCCTGCTGAT CAGCTGGGTCCCGCCTTCAGATGATTACGGTTATTACCGCATCACTTACGGCGAAACAGGAGGCA ATAGCCCTGTCCAGGAGTTCACTGTGCCTATTGGTAAAGGAACAGCTACCATCAGCGGCCTTAAA CCTGGCGTTGATTATACCATCACTGTGTATGCTGTCGAGTTTCCGTGGCCACATGCTGGTTACTA TCATCGGCCAATTTCCATTAATTACCGCACAGAAATTGAGAAACCATGCCAGTG (SEQ ID NO: 83) |
| ATI001114* [2013E01cys mut] also referred to as ATI-1114 | MGVSDVPRDLEVVAATPTSL LISWVPPSDDYGYYRITYGE TGGNSPVQEFTVPIGKGTAT ISGLKPGVDYTITVYAVEFP WPHAGYYHRPISINYRTSGS CHHHHHH (SEQ ID NO: 84) | ATGGGAGTTTCTGATGTGCCGCGCGACCTGGAAGTGGTTGCTGCCACCCCCACCAGCCTGCTGAT CAGCTGGGTCCCGCCTTCAGATGATTACGGTTATTACCGCATCACTTACGGCGAAACAGGAGGCA ATAGCCCTGTCCAGGAGTTCACTGTGCCTATTGGTAAAGGAACAGCTACCATCAGCGGCCTTAAA CCTGGCGTTGATTATACCATCACTGTGTATGCTGTCGAGTTTCCGTGGCCACATGCTGGTTACTA TCATCGGCCAATTTCCATTAATTACCGCACAGGTAGCGGTTGCCACCATCACCACCATCAC (SEQ ID NO: 85) |
| ATI000959* [1459D05 cys mut] | MGVSDVPRDLEVVAATPTSL LISWPPPSHGYGYYRITYGE TGGNSPVQEFTVPPGKGTAT ISGLKPGVDYTITVYAVEYP YKHSGYYHRPISINYRTEID KPCQHHHHHH (SEQ ID NO: 86) | ATGGGAGTTTCTGATGTGCCGCGCGACCTGGAAGTGGTTGCTGCCACCCCCACCAGCCTGCTGAT CAGCTGGCCGCCGCCGTCTCATGGTTACGGTTATTACCGCATCACTTACGGCGAAACAGGAGGCA ATAGCCCTGTCCAGGAGTTCACTGTGCCGCCTGGTAAAGGTACAGCTACCATCAGCGGCCTTAAA CCTGGCGTTGATTATACCATCACTGTGTATGCTGTCGAATACCCGTACAAACATTCTGGTTACTA CCATCGTCCAATTTCCATTAATTACCGCACAGAAATTGACAAACCATGCCAGCACCATCACCACC ACCAC (SEQ ID NO: 87) |
| ATI001063* [1784F03 Cys mut] | MGVSDVPRDLEVVAATPTSL LISWRPPIHAYGYYRITYGE TGGNSPVQEFTVPIVEGTAT ISGLKPGVDYTITVYAVEYT FKHSGYYHRPISINYRTEID KPCQHHHHHH (SEQ ID NO: 88) | ATGGGAGTTTCTGATGTGCCGCGCGACCTGGAAGTGGTTGCTGCCACCCCCACCAGCCTGCTGAT CAGCTGGAGGCCGCCGATTCATGCTTACGGGTATTACCGCATCACTTACGGCGAAACAGGAGGCA ATAGCCCTGTCCAGGAGTTCACTGTGCCTATTGTTGAAGGTACAGCTACCATCAGCGGCCTTAAA CCTGGCGTTGATTATACCATCACTGTGTATGCTGTCGAATACATTTAAACATTCCGGTTACTA CCATCGTCCAATTTCCATTAATTACCGCACAGAAATTGACAAACCATGCCAGCACCATCACCACC ACCAC (SEQ ID NO: 89) |
| ATI001119* [2012A04 Cys mut] | MGVSDVPRDLEVVAATPTSL LISWRPPSNGHGYYRITYGE TGGNSPVQEFTVPVNEGTAT | ATGGGAGTTTCTGATGTGCCGCGCGACCTGGAAGTGGTTGCTGCCACCCCCACCAGCCTGCTGAT CAGCTGGCGGCCCCCCTCTAATGGTCACGGTTATTACCGCATCACTTACGGCGAAACAGGAGGCA ATAGCCCTGTCCAGGAGTTCACTGTGCCTGTTAATGAAGGTACAGCTACCATCAGCGGCCTTAAA |

TABLE 5-continued

Anti-PCSK9 Adnectin Family Cysteine Mutants to Enable Pegylation

| ATI#/Clone# [Description] | Sequence AA | NT |
|---|---|---|
| | ISGLKPGVDYTITVYAVEFP FKWSGYYHRPISINYRTGSG CHHHHHH (SEQ ID NO: 90) | CCTGGCGTTGATTATACCATCACTGTGTATGCTGTCGAATTCCCCTTCAAGTGGTCGGGCTACTA CCATCGACCAATTTCCATTAATTACCGCACAGGTAGCGGTTGCCACCATCACCACCATCAC (SEQ ID NO: 91) |
| ATI001117* [2011H05 Cys mut] | MGVSDVPRDLEVVAATPTSL LISWVPSSHAYGYYRITYGE TGGNSPVQEFTVPVGVGTAT ISGLKPGVDYTITVYAVEYA FEGAGYYHRPISINYRTGSG CHHHHHH (SEQ ID NO: 92) | ATGGGAGTTTCTGATGTGCCGCGCGACCTGGAAGTGGTTGCTGCCACCCCCACCAGCCTGCTGAT CAGCTGGGTTCCGTCGTCTCATGCCTACGGTTATTACCGCATCACTTACGGCGAAACAGGAGGCA ATAGCCCTGTCCAGGAGTTCACTGTGCCTGTGGGGGTAGGTACAGCTACCATCAGCGGCCTTAAA CCTGGCGTTGATTATACCATCACTGTGTATGCTGTCGAATACGCTTTCGAAGGGGCTGGTTACTA CCATCGTCCAATTTCCATTAATTACCGCACAGGTAGCGGTTGCCACCATCACCACCATCAC (SEQ ID NO: 93) |
| ATI001194* [2011H05(V23D) Cys mut] | MGVSDVPRDLEVVAATPTSL LISWDPSSHAYGYYRITYGE TGGNSPVQEFTVPVGVGTAT ISGLKPGVDYTITVYAVEYA FEGAGYYHRPISINYRTEGS GCHHHHHH (SEQ ID NO: 94) | ATGGGAGTTTCTGATGTGCCGCGCGACCTGGAAGTGGTTGCTGCCACCCCCACCAGCCTGCTGAT CAGCTGGGACCCGTCGTCTCATGCCTACGGTTATTACCGCATCACTTACGGCGAAACAGGAGGCA ATAGCCCTGTCCAGGAGTTCACTGTGCCTGTGGGGGTAGGTACAGCTACCATCAGCGGCCTTAAA CCTGGCGTTGATTATACCATCACTGTGTATGCTGTCGAATACGCTTTCGAAGGGGCTGGTTACTA CCATCGTCCAATTTCCATTAATTACCGCACAGAAGGTAGCGGTTGCCACCATCACCACCATCAC (SEQ ID NO: 95) |
| 2011H05 (V23E)- Cys mut | MGVSDVPRDLEVVAATPTSL LISWEPSSHAYGYYRITYGE TGGNSPVQEFTVPVGVGTAT ISGLKPGVDYTITVYAVEYA FEGAGYYHRPISINYRTEGS GCHHHHHH (SEQ ID NO: 96) | ATGGGAGTTTCTGATGTGCCGCGCGACCTGGAAGTGGTTGCTGCCACCCCCACCAGCCTGCTGAT CAGCTGGGAACCGTCGTCTCATGCCTACGGTTATTACCGCATCACTTACGGCGAAACAGGAGGCA ATAGCCCTGTCCAGGAGTTCACTGTGCCTGTGGGGGTAGGTACAGCTACCATCAGCGGCCTTAAA CCTGGCGTTGATTATACCATCACTGTGTATGCTGTCGAATACGCTTTCGAAGGGGCTGGTTACTA CCATCGTCCAATTTCCATTAATTACCGCACAGAAGGTAGCGGTTGCCACCATCACCACCATCAC (SEQ ID NO: 97) |
| ATI001112 [1923B02 Cys mut] | MGVSDVPRDLEVVAATPTSL LISWTPPPKGYGYYRITYGE TGGNSPVQEFTVPVGEGTAT ISGLKPGVDYTITVYAVEYT YNGAGYYHRPISINYRTGSG CHHHHHH (SEQ ID NO: 98) | ATGGGAGTTTCTGATGTGCCGCGCGACCTGGAAGTGGTTGCTGCCACCCCCACCAGCCTGCTGAT CAGCTGGACGCCTCCCCCTAAAGGGTATGGTTATTACCGCATCACTTACGGCGAAACAGGAGGCA ATAGCCCTGTCCAGGAGTTCACTGTGCCTGTTGGTGAAGGTACAGCTACCATCAGCGGCCTTAAA CCTGGCGTTGATTATACCATCACTGTGTATGCTGTCGAATACGTACAACGGTGCCGGTTACTA CCACCGGCCAATTTCCATTAATTACCGCACAGGTAGCGGTTGCCACCATCACCACCATCAC (SEQ ID NO: 99) |
| ATI001110 [1922G04 Cys mut] | MGVSDVPRDLEVVAATPTSL LISWRPPSHAYGYYRITYGE TGGNSPVQEFTVPIGKGTAT ISGLKPGVDYTITVYAVEYP WKGSGYYHRPISINYRTGSG CHHHHHH (SEQ ID NO: 100) | ATGGGAGTTTCTGATGTGCCGCGCGACCTGGAAGTGGTTGCTGCCACCCCCACCAGCCTGCTGAT CAGCTGGCGGCCGCCATCTCATGCTTATGGTTATTACCGCATCACTTACGGCGAAACAGGAGGCA ATAGCCCTGTCCAGGAGTTCACTGTGCCTATTGGGAAAGGTACAGCTACCATCAGCGGCCTTAAA CCTGGCGTTGATTATACCATCACTGTGTATGCTGTCGAATACCCGTGGAAAGGTTCTGGTTACTA CCATCGGCCAATTTCCATTAATTACCGCACAGGTAGCGGTTGCCACCATCACCACCATCAC (SEQ ID NO: 101) |
| ATI001128 [1922G04 Cys mut] | MGVSDVPRDLEVVAATPTSL LISWRPPSHAYGYYRITYGE TGGNSPVQEFTVPIGKGTAT ISGLKPGVDYTITVYAVEYP WKGSGYYHRPISINYRTEID KPCQHHHHHH (SEQ ID NO: 102) | ATGGGAGTTTCTGATGTGCCGCGCGACCTGGAAGTGGTTGCTGCCACCCCCACCAGCCTGCTGAT CAGCTGGCGGCCGCCATCTCATGCTTATGGTTATTACCGCATCACTTACGGCGAAACAGGAGGCA ATAGCCCTGTCCAGGAGTTCACTGTGCCTATTGGGAAAGGTACAGCTACCATCAGCGGCCTTAAA CCTGGCGTTGATTATACCATCACTGTGTATGCTGTCGAATACCCGTGGAAAGGTTCTGGTTACTA CCATCGGCCAATTTCCATTAATTACCGCACAGAAATTGACAAACCATGCCAGCACCACCACCACC ACCAC (SEQ ID NO: 103) |
| ATI001184* [1922G04(R23E) Cys mut] | MGVSDVPRDLEVVAATPTSL LISWEPPSHAYGYYRITYGE TGGNSPVQEFTVPIGKGTAT ISGLKPGVDYTITVYAVEYP WKGSGYYHRPISINYRTEGS GCHHHHHH (SEQ ID NO: 104) | ATGGGAGTTTCTGATGTGCCGCGCGACCTGGAAGTGGTTGCTGCCACCCCCACCAGCCTGCTGAT CAGCTGGGAACCGCCATCTCATGCTTATGGTTATTACCGCATCACTTACGGCGAAACAGGAGGCA ATAGCCCTGTCCAGGAGTTCACTGTGCCTATTGGGAAAGGTACAGCTACCATCAGCGGCCTTAAA CCTGGCGTTGATTATACCATCACTGTGTATGCTGTCGAATACCCGTGGAAAGGTTCTGGTTACTA CCATCGGCCAATTTCCATTAATTACCGCACAGAAGGTAGCGGTTGCCACCATCACCACCATCAC (SEQ ID NO: 105) |
| 2381D04-Cys | MGVSDVPRDLEVVAATPTSL LISWEPFSRLPGGGEYYRIT YGETGGNSPLQQFTVPGSKG TATISGLKPGVDYTITVYAV EFPYDHSGYYHRPISINYRT GSGCHHHHHH (SEQ ID NO: 291) | ATGGGAGTTTCTGATGTGCCGCGCGACCTGGAAGTGGTTGCTGCCACCCCCACCAGCCTGCTGAT CAGCTGGGAGCCGTTCAGCCGGTTGCCCGGGGCGGCGAGTATTACCGGATCACTTACGGCGAAA CAGGAGGCAATAGCCCTCTGCAGCAGTTCACTGTGCCTGGTTCTAAAGGTACAGCTACCATCAGC GGCCTTAAACCTGGCGTTGATTATACCATCACTGTGTATGCTGTCGAATTCCCGTACGACCATTC TGGTTACTACCATCGGCCATTTCCATTAATTACCGCACAGGTAGCGGTTGCCACCATCACCACC ATCAC (SEQ ID NO: 292) |
| 2382D09-Cys | MGVSDVPRDLEVVAATPTSL LISWDAPAEGYGYYRITYGE TGGNSPVQEFTVPVSKGTAT | ATGGGAGTTTCTGATGTGCCGCGCGACCTGGAAGTGGTTGCTGCCACCCCCACCAGCCTGCTGAT CAGCTGGGACGCTCCGGCTGAAGGGTACGGTTATTACCGCATCACTTACGGCGAAACAGGAGGCA ATAGCCCTGTCCAGGAGTTCACTGTGCCTGTTTCTAAAGGTACAGCTACCATCAGCGGCCTTAAA |

TABLE 5-continued

Anti-PCSK9 Adnectin Family Cysteine Mutants to Enable Pegylation

| ATI#/Clone# [Description] | Sequence AA | NT |
|---|---|---|
|  | ISGLKPGVDYTITVYAVEFD FPGAGYYHRPISINYRTGSG CHHHHHH (SEQ ID NO: 293) | CCTGGCGTTGATTATACCATCACTGTGTATGCTGTCGAATTCGACTTCCCCGGCGCCGGTTACTA CCATCGTCCAATTTCCATTAATTACCGCACAGGTAGCGGTTGCCACCATCACCACCATCAC (SEQ ID NO: 294) |
| 2451B06-Cys | MGVSDVPRDLEVVAATPTSL LISWDAPADGGYGYYRITYG ETGGNSPVQEFTVPVSKGTA TISGLKPGVDYTITVYAVEF DFPGAGYYHRPISINYRTGS GCHHHHHH (SEQ ID NO: 295) | ATGGGAGTTTCTGATGTGCCGCGCGACCTGGAAGTGGTTGCTGCCACCCCCACCAGCCTGCTGAT CAGCTGGGACGCTCCGGCTGATGGTGGTTACGGTTATTACCGCATCACTTACGGCGAAACAGGAG GCAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGGCGCCGGTTA CTACCATCGTCCAATTTCCATTAATTACCGCACAGGTAGCGGTTGCCACCATCACCACCATCAC (SEQ ID NO: 296) |
| 2382E05-Cys | MGVSDVPRDLEVVAATPTSL LISWDAPAEGGYGYYRITYG ETGGNSPVQEFTVPVSKGTA TISGLKPGVDYTITVYAVEF DFPGAGYYHRPISINYRTGS GCHHHHHH (SEQ ID NO: 297) | ATGGGAGTTTCTGATGTGCCGCGCGACCTGGAAGTGGTTGCTGCCACCCCCACCAGCCTGCTGAT CAGCTGGGACGCTCCGGCTGAGGGCGGCTACGGTTATTACCGCATCACTTACGGCGAAACAGGAG GCAATAGCCCTGTCCAGGAGTTCACTGTGCCTGTTTCTAAAGGTACAGCTACCATCAGCGGCCTT AAACCTGGCGTTGATTATACCATCACTGTGTATGCTGTCGAATTCGACTTCCCCGGCGCCGGTTA CTACCATCGTCCAATTTCCATTAATTACCGCACAGGTAGCGGTTGCCACCATCACCACCATCAC (SEQ ID NO: 298) |
| 2382B09-Cys | MGVSDVPRDLEVVAATPTSL LISWDAPADAYGYYRITYGE TGGNSPVQEFTVPVSKGTAT ISGLKPGVDYTITVYAVEFD YPGSGYYHRPISINYRTGSG CHHHHHH (SEQ ID NO: 299) | ATGGGAGTTTCTGATGTGCCGCGCGACCTGGAAGTGGTTGCTGCCACCCCCACCAGCCTGCTGAT CAGCTGGGACGCTCCGGCTGACGCGTACGGTTATTACCGCATCACTTACGGCGAAACAGGAGGCA ATAGCCCTGTCCAGGAGTTCACTGTGCCTGTTTCTAAAGGTACAGCTACCATCAGCGGCCTTAAA CCTGGCGTTGATTATACCATCACTGTGTATGCTGTCGAATTCGACTACCCCGGCTCCGGTTACTA CCATCGTCCAATTTCCATTAATTACCGCACAGGTAGCGGTTGCCACCATCACCACCATCAC (SEQ ID NO: 300) |

*Note: Some proteins listed have not yet been pegylated but are enabled to be pegylated via the cysteine mutation. Proteins that have been pegylated are indicated by asterisk.

Nucleic Acid-Protein Fusion Technology

In one aspect, the application provides an Adnectin comprising fibronectin type III domains that binds PCSK9. One way to rapidly make and test Fn3 domains with specific binding properties is the nucleic acid-protein fusion technology of Adnexus, a Bristol-Myers Squibb R&D Company. This disclosure utilizes the in vitro expression and tagging technology, termed PROfusion' which exploits nucleic acid-protein fusions (RNA- and DNA-protein fusions) to identify novel polypeptides and amino acid motifs that are important for binding to proteins. Nucleic acid-protein fusion technology is a technology that covalently couples a protein to its encoding genetic information. For a detailed description of the RNA-protein fusion technology and fibronectin-based scaffold protein library screening methods see Szostak et al., U.S. Pat. Nos. 6,258,558, 6,261,804, 6,214,553, 6,281,344, 6,207,446, 6,518,018 and 6,818,418; and Roberts et al., *Proc. Natl. Acad. Sci.*, 94:12297-12302 (1997), herein incorporated by reference.

Vectors and Polynucleotide Embodiments

Nucleic acids encoding any of the various proteins or polypeptides disclosed herein may be synthesized chemically. Codon usage may be selected so as to improve expression in a cell. Such codon usage will depend on the cell type selected. Specialized codon usage patterns have been developed for *E. coli* and other bacteria, as well as mammalian cells, plant cells, yeast cells and insect cells. See for example: Mayfield et al., *Proc. Natl. Acad. Sci. USA*, 100(2):438-442 (Jan. 21, 2003); Sinclair et al., *Protein Expr. Purif.*, 26(I):96-105 (October 2002); Connell, N. D., *Curr. Opin. Biotechnol.*, 12(5):446-449 (October 2001); Makrides et al., *Microbiol. Rev.*, 60(3):512-538 (September 1996); and Sharp et al., *Yeast*, 7(7):657-678 (October 1991).

General techniques for nucleic acid manipulation are described for example in Sambrook et al., *Molecular Cloning: A Laboratory Manual*, 2nd Edition, Vols. 1-3, Cold Spring Harbor Laboratory Press (1989), or Ausubel, F. et al., *Current Protocols in Molecular Biology*, Green Publishing and Wiley-Interscience, New York (1987) and periodic updates, herein incorporated by reference. Generally, the DNA encoding the polypeptide is operably linked to suitable transcriptional or translational regulatory elements derived from mammalian, viral, or insect genes. Such regulatory elements include a transcriptional promoter, an optional operator sequence to control transcription, a sequence encoding suitable mRNA ribosomal binding sites, and sequences that control the termination of transcription and translation. The ability to replicate in a host, usually conferred by an origin of replication, and a selection gene to facilitate recognition of transformants is additionally incorporated.

The proteins described herein may be produced recombinantly not only directly, but also as a fusion polypeptide with a heterologous polypeptide, which is preferably a signal sequence or other polypeptide having a specific cleavage site at the N-terminus of the mature protein or polypeptide. The heterologous signal sequence selected preferably is one that is recognized and processed (i.e., cleaved by a signal peptidase) by the host cell. An exemplary N-terminal leader sequence for production of polypeptides in a mammalian system is METDTLLLWVLLLWVPGSTG (SEQ ID NO: 326), which is removed by the host cell following expression.

For prokaryotic host cells that do not recognize and process a native signal sequence, the signal sequence is substituted by a prokaryotic signal sequence selected, for example, from the group of the alkaline phosphatase, penicillinase, 1 pp, or heat-stable enterotoxin II leaders.

For yeast secretion the native signal sequence may be substituted by, e.g., the yeast invertase leader, a factor leader (including *Saccharomyces* and *Kluyveromyces* alpha-factor leaders), or acid phosphatase leader, the *C. albicans* glucoamylase leader, or the signal described in U.S. Pat. No. 5,631,144. In mammalian cell expression, mammalian signal sequences as well as viral secretory leaders, for example, the herpes simplex gD signal, are available. The DNA for such precursor regions may be ligated in reading frame to DNA encoding the protein.

Both expression and cloning vectors contain a nucleic acid sequence that enables the vector to replicate in one or more selected host cells. Generally, in cloning vectors this sequence is one that enables the vector to replicate independently of the host chromosomal DNA, and includes origins of replication or autonomously replicating sequences. Such sequences are well known for a variety of bacteria, yeast, and viruses. The origin of replication from the plasmid pBR322 is suitable for most Gram-negative bacteria, the 2 micron plasmid origin is suitable for yeast, and various viral origins (SV40, polyoma, adenovirus, VSV or BPV) are useful for cloning vectors in mammalian cells. Generally, the origin of replication component is not needed for mammalian expression vectors (the SV40 origin may typically be used only because it contains the early promoter).

Expression and cloning vectors may contain a selection gene, also termed a selectable marker. Typical selection genes encode proteins that (a) confer resistance to antibiotics or other toxins, e.g., ampicillin, neomycin, methotrexate, or tracycline, (b) complement auxotrophic deficiencies, or (c) supply critical nutrients not available from complex media, e.g., the gene encoding D-alanine racemase for Bacilli.

Expression and cloning vectors usually contain a promoter that is recognized by the host organism and is operably linked to the nucleic acid encoding the protein of the invention, e.g., a fibronectin-based scaffold protein. Promoters suitable for use with prokaryotic hosts include the phoA promoter, beta-lactamase and lactose promoter systems, alkaline phosphatase, a tryptophan (trp) promoter system, and hybrid promoters such as the tan promoter. However, other known bacterial promoters are suitable. Promoters for use in bacterial systems also will contain a Shine-Dalgarno (S.D.) sequence operably linked to the DNA encoding the protein of the invention. Promoter sequences are known for eukaryotes. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tall to the 3' end of the coding sequence. All of these sequences are suitably inserted into eukaryotic expression vectors.

Examples of suitable promoting sequences for use with yeast hosts include the promoters for 3-phosphoglycerate kinase or other glycolytic enzymes, such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase.

Transcription from vectors in mammalian host cells can be controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatitis-B virus and most preferably Simian Virus 40 (SV40), from heterologous mammalian promoters, e.g., the actin promoter or an immunoglobulin promoter, from heat-shock promoters, provided such promoters are compatible with the host cell systems.

Transcription of a DNA encoding proteins of the invention by higher eukaryotes is often increased by inserting an enhancer sequence into the vector. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (bp 100-270), the cytomegalovirus early promoter enhancer, the polyoma enhancer on the late side of the replication origin, and adenovirus enhancers. See also Yaniv, *Nature*, 297:17-18 (1982) on enhancing elements for activation of eukaryotic promoters. The enhancer may be spliced into the vector at a position 5' or 3' to the peptide-encoding sequence, but is preferably located at a site 5' from the promoter.

Expression vectors used in eukaryotic host cells (e.g., yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of mRNA encoding the protein of the invention. One useful transcription termination component is the bovine growth hormone polyadenylation region. See WO 94/11026 and the expression vector disclosed therein.

The recombinant DNA can also include any type of protein tag sequence that may be useful for purifying the protein. Examples of protein tags include but are not limited to a histidine tag, a FLAG tag, a myc tag, an HA tag, or a GST tag. Appropriate cloning and expression vectors for use with bacterial, fungal, yeast, and mammalian cellular hosts can be found in *Cloning Vectors: A Laboratory Manual*, (Elsevier, New York (1985)), the relevant disclosure of which is hereby incorporated by reference.

The expression construct is introduced into the host cell using a method appropriate to the host cell, as will be apparent to one of skill in the art. A variety of methods for introducing nucleic acids into host cells are known in the art, including, but not limited to, electroporation; transfection employing calcium chloride, rubidium chloride, calcium phosphate, DEAE-dextran, or other substances; microprojectile bombardment; lipofection; and infection (where the vector is an infectious agent).

Suitable host cells include prokaryotes, yeast, mammalian cells, or bacterial cells. Suitable bacteria include gram negative or gram positive organisms, for example, *E. coli* or *Bacillus* spp. Yeast, preferably from the *Saccharomyces* species, such as *S. cerevisiae*, may also be used for production of polypeptides. Various mammalian or insect cell culture systems can also be employed to express recombinant proteins. Baculovirus systems for production of heterologous proteins in insect cells are reviewed by Luckow et al. (*Bio/Technology*, 6:47 (1988)). Examples of suitable mammalian host cell lines include endothelial cells, COS-7 monkey kidney cells, CV-1, L cells, C127, 3T3, Chinese hamster ovary (CHO), human embryonic kidney ceils, HeLa, 293, 293T, and BHK cell lines. Purified polypeptides are prepared by culturing suitable host/vector systems to express the recombinant proteins. For many applications, the small size of many of the polypeptides disclosed herein would make expression in *E. coli* as the preferred method for expression. The protein is then purified from culture media or cell extracts.

Protein Production

Host cells are transformed with the herein-described expression or cloning vectors for protein production and cultured in conventional nutrient media modified as appropriate for inducing promoters, selecting transformants, or amplifying the genes encoding the desired sequences. In the examples shown here, the host cells used for high-throughput protein production (HTPP) and mid-scale production was the HMS174-bacterial strain. The host cells used to produce the proteins of this invention may be cultured in a variety of media. Commercially available media such as Ham's F10 (Sigma), Minimal Essential Medium ((MEM), (Sigma)), RPMI-1640 (Sigma), and Dulbecco's Modified Eagle's Medium ((DMEM), Sigma)) are suitable for culturing the host cells. In addition, may of the media described in Ham et al., *Meth. Enzymol.*, 58:44 (1979), Barites et al., *Anal. Biochem.*, 102:255 (1980), U.S. Pat. Nos. 4,767,704, 4,657,866, 4,927,762, 4,560,655, 5,122,469, 6,048,728, 5,672,502, or U.S. Pat. No. RE 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

Proteins disclosed herein can also be produced using cell-translation systems. For such purposes the nucleic acids encoding the polypeptide must be modified to allow in vitro transcription to produce mRNA and to allow cell-free translation of the mRNA in the particular cell-free system being utilized (eukaryotic such as a mammalian or yeast cell-free translation system or prokaryotic such as a bacterial ceil-free translation system.

Proteins of the invention can also be produced by chemical synthesis (e.g., by the methods described in *Solid Phase Peptide Synthesis*, 2nd Edition, The Pierce Chemical Co., Rockford, Ill. (1984)). Modifications to the protein can also be produced by chemical synthesis.

The proteins of the present invention can be purified by isolation/purification methods for proteins generally known in the field of protein chemistry. Non-limiting examples include extraction, recrystallization, salting out (e.g., with ammonium sulfate or sodium sulfate), centrifugation, dialysis, ultrafiltration, adsorption chromatography, ion exchange chromatography, hydrophobic chromatography, normal phase chromatography, reversed-phase chromatography, get filtration, gel permeation chromatography, affinity chromatography, electrophoresis, countercurrant distribution or any combinations of these. After purification, polypeptides may be exchanged into different buffers and/or concentrated by any of a variety of methods known to the art, including, but not limited to, filtration and dialysis.

The purified polypeptide is preferably at least 85% pure, or preferably at least 95% pure, and most preferably at least 98% pure. Regardless of the exact numerical value of the purity, the polypeptide is sufficiently pure for use as a pharmaceutical product.

A platform manufacturing process was used to prepare anti-PCSK9 Adnectin. The anti-PCSK9 Adnectin is produced in *Escherichia coli* (*E. coli*). *E. coli* BLR (DE3) cells were transformed with expression vector (pET9d/ATI001173) which produces the protein in a soluble form intracellularly. The recombinant strain is grown in stirred tank fermentors. At the end of fermentation the cells are collected, lysed, and clarified in preparation for purification. ATI001173 is a non-his tagged version of ATI001114. The purified anti-PCSK9 Adnectin is conjugated to a 40 kDa branched methoxyPEG using a maleimide linker. The conjugated material is subsequently repurified to remove free PEG, free anti-PCSK9 Adnectin and product related impurities. Quality control testing is performed on the bulk drug substance.

Therapeutic In Vivo Uses

In one aspect, the application provides anti-PCSK9 Adnectin useful in the treatment of atherosclerosis, hypercholesterolemia and other cholesterol related diseases. The application also provides methods for administering anti-PCSK9 Adnectin to a subject. In some embodiments, the subject is a human. In some embodiments, the anti-PCSK9 Adnectin are pharmaceutically acceptable to a mammal, in particular a human. A "pharmaceutically acceptable" polypeptide refers to a polypeptide that is administered to an animal without significant adverse medical consequences, such as essentially endotoxin free, or very low endotoxin levels.

Formulation and Administration

The application further provides pharmaceutically acceptable compositions comprising the anti-PCSK9 Adnectin or fusion proteins thereof described herein, wherein the composition is essentially endotoxin free. Therapeutic formulations comprising anti-PCSK9 Adnectin or fusions thereof are prepared for storage by mixing the described polypeptide having the desired degree of purity with optional physiologically acceptable carriers, excipients or stabilizers (Osol, A., *Remington's Pharmaceutical Sciences,* 16th Edition (1980)), in the form of aqueous solutions, lyophilized or other dried formulations. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g., Zn-protein complexes); and/or non-ionic surfactants such as Tween, PLURONIC® or polyethylene glycol (PEG).

The formulations herein may also contain more than one active compound as necessary for the particular indication being treated, preferably those with complementary activities that do not adversely affect each other. Such molecules are suitably present in combination in amounts that are effective for the purpose intended.

The formulations to be used for in vivo administration must be sterile. This is readily accomplished by filtration through sterile filtration membranes.

The skilled artisan will understand that the dosage of each therapeutic agent will be dependent on the identity of the agent.

For therapeutic applications, the anti-PCSK9 Adnectin or a fusion protein comprising an anti-PCSK9 Adnectin is administered to a subject, in a pharmaceutically acceptable dosage form. They can be administered intravenously as a bolus or by continuous infusion over a period of time, or by subcutaneous routes. Suitable pharmaceutically acceptable carriers, diluents, and excipients are well known and can be determined by those of skill in the art as the clinical situation warrants. Examples of suitable carriers, diluents and/or excipients include: (1) Dulbecco's phosphate buffered saline, (2) 0.9% saline (0.9% w/v NaCl), and (3) 5% (w/v) dextrose.

The method of the present invention can be practiced in vitro, in vivo, or ex vivo.

Administration of anti-PCSK9 Adnectin or a fusion thereof, and one or more additional therapeutic agents, whether co-administered or administered sequentially, may occur as described above for therapeutic applications. Suitable pharmaceutically acceptable carriers, diluents, and excipients for co-administration will be understood by the skilled artisan to depend on the identity of the particular therapeutic agent being administered.

When present in an aqueous dosage form, rather than being lyophilized, the protein typically will be formulated at a concentration of about 0.1 mg/ml to 100 mg/ml, although wide variation outside of these ranges is permitted. For the treatment of disease, the appropriate dosage of anti-PCSK9 Adnectin or a fusion thereof will depend on the type of disease to be treated, the severity and course of the disease, whether the protein is administered for preventive or therapeutic purposes, the course of previous therapy, the patient's clinical history and response to the protein, and the discretion of the attending physician. The protein is suitably administered to the patient at one time or over a series of treatments.

Fusions of Serum Albumin Binding Adnectin (SABA)

In certain aspects, the application provides fusion proteins comprising anti-PCSK9 Adnectin fused to a $^{10}$Fn3 domains that binds to human serum albumin (a Serum Albumin Binding Adnectin ($^{10}$Fn3 domain) or SABA). Such fusion proteins have extended serum half lives in the presence of albumin relative to the anti-PCSK9 Adnectin alone (e.g., not conjugated to a PK moiety).

$^{10}$Fn3 domains are cleared rapidly from circulation via renal filtration and degradation due to their small size of ~10 kDa ($t_{1/2}$=15-45 minutes in mice; 1-3 hours in monkeys). Fusion of a $^{10}$Fn3 domain, such as an anti-PCSK9 Adnectin, to a second polypeptide comprising a $^{10}$Fn3 domain that binds specifically to serum albumin, e.g., human serum albumin (HSA), may be used to prolong the $t_{1/2}$ of the anti-PCSK9 Adnectin.

In certain embodiments, the serum half-life of the anti-PCSK9 Adnectin fused to the SABA is increased relative to the serum half-life of the anti-PCSK9 Adnectin when not conjugated to the SABA. In certain embodiments, the serum half-life of the SABA fusion is at least 20, 40, 60, 80, 100, 120, 150, 180, 200, 400, 600, 800, 1000, 1200, 1500, 1800, 1900, 2000, 2500, or 3000% longer relative to the serum half-life of the anti-PCSK9 Adnectin when not fused to the SABA. In other embodiments, the serum half-life of the SABA fusion is at least 1.5-fold, 2-fold, 2.5-fold, 3-fold, 3.5 fold, 4-fold, 4.5-fold, 5-fold, 6-fold, 7-fold, 8-fold, 10-fold, 12-fold, 13-fold, 15-fold, 17-fold, 20-fold, 22-fold, 25-fold, 27-fold, 30-fold, 35-fold, 40-fold, or 50-fold greater than the serum half-life of the anti-PCSK9 Adnectin when not fused to the SABA. In some embodiments, the serum half-life of the SABA fusion is at least 10 hours, 15 hours, 20 hours, 25 hours, 30 hours, 35 hours, 40 hours, 50 hours, 60 hours, 70 hours, 80 hours, 90 hours, 100 hours, 110 hours, 120 hours, 130 hours, 135 hours, 140 hours, 150 hours, 160 hours, or 200 hours.

In certain embodiments, the serum albumin binding portion of the SABA fusion protein binds to HSA with a $K_D$ of less than 3 uM, 2.5 uM, 2 uM, 1.5 uM, 1 uM, 500 nM, 100 nM, 50 nM, 10 nM, 1 nM, 500 pM, 100 pM. 100 pM, 50 pM or 10 pM. In certain embodiments, the serum albumin binding portion of the SABA fusion proteins bind to HSA with a $K_D$ of less than 3 uM, 2.5 uM, 2 uM, 1.5 uM, 1 uM, 500 nM, 100 nM, 50 nM, 10 nM, 1 nM, 500 pM, 100 pM. 100 pM, 50 pM or 10 pM at a pH range of 5.5 to 7.4 at 25° C. or 37° C. In some embodiments, the serum albumin binding portion of the SABA fusion proteins bind more tightly to HSA at a pH less than 7.4 as compared to binding at pH 7.4.

Accordingly, the SABA fusion molecules described herein are useful for increasing the half-life of anti-PCSK9 Adnectin by creating a fusion between anti-PCSK9 Adnectin and the SABA. Such fusion molecules may be used to treat conditions which respond to the biological activity of PCSK9. The present invention contemplates the use of the SABA fusion molecules in diseases caused by the dysregulation of PCSK9.

The fusion may be formed by attaching anti-PCSK9 Adnectin to either end of the SABA molecule, i.e., SABA-anti-PCSK9 Adnectin or anti-PCSK9 Adnectin-SABA arrangements.

HSA has a serum concentration of 600 μM and a $t_{1/2}$ of 19 days in humans. The extended $t_{1/2}$ of HSA has been attributed, in part, to its recycling via the neonatal Fc receptor (FcRn). HSA binds FcRn in a pH-dependent manner after endosomal uptake into endothelial cells; this interaction recycles HSA back into the bloodstream, thereby shunting it away from lysosomal degradation. FcRn is widely expressed and the recycling pathway is thought to be constitutive. In the majority of cell types, most FcRn resides in the intracellular sorting endosome. HSA is readily internalized by a nonspecific mechanism of fluid-phase pinocytosis and rescued from degradation in the lysosome by FcRn. At the acidic pH found in the endosome, HSA's affinity for FcRn increases (5 μM at pH 6.0). Once bound to FcRn, HSA is shunted away from the lysosomal degradation pathway, transcytosed to and released at the cell surface.

In certain embodiments, the serum albumin binding portion of the SABA fusion proteins described herein may also bind serum albumin from one or more of monkey, rat, or mouse. In certain embodiments, the HSA binding portion of the SABA fusion proteins described herein bind to rhesus serum albumin (RhSA) or cynomolgous monkey serum albumin (CySA) with a $K_D$ of less than 3 uM, 2.5 uM, 2 uM, 1.5 uM, 1 uM, 500 nM, 100 nM, 50 nM, 10 nM, 1 nM, 500 pM or 100 pM.

In certain embodiments, the serum albumin binding portion of the SABA fusion proteins described herein bind to domain I and/or domain II of HSA. In one embodiment, the HSA binding portion of the SABA fusion proteins described herein do not bind to domain III of HSA.

In certain embodiments, the serum albumin binding portion of the SABA fusion proteins comprises a sequence having at least 40%, 50%, 60%, 70%, 75%, 80% or 85% identity to the wild-type $^{10}$Fn3 domain (SEQ ID NO: 1). In one embodiment, at least one of the BC, DE, or FG loops is modified relative to the wild-type $^{10}$Fn3 domain. In another embodiment, at least two of the BC, DE, or FG loops are modified relative to the wild-type $^{10}$Fn3 domain. In another embodiment, all three of the BC, DE, and FG loops are modified relative to the wild-type $^{10}$Fn3 domain. In other embodiments, a SABA comprises a sequence having at least 40%, 50%, 60%, 70%, 75%, 80%, 85%, 90%, or 95% identity to any one of the 26 core SABA sequences shown in Table 6 (i.e., SEQ ID NO: 334, 338, 342, 346, and 348-370) or any one of the extended SABA sequences shown in Table 6 (i.e., SEQ ID NO: 420-447, minus the 6×HIS tag).

In certain embodiments, the serum binding Adnectins based on the $^{10}$Fn3 scaffold can be defined generally by the following sequence:

(SEQ ID NO: 328)
EVVAAT(X)$_a$SLLI(X)$_x$YYRITYGE(X)$_b$QEFTV(X)$_y$ATI(X)$_c$DYTI

TVYAV(X)$_z$ISINYRT

In certain embodiments, the serum binding Adnectins based on the $^{10}$Fn3 scaffold can be defined generally by the sequence:

(SEQ ID NO: 329)
EVVAATPTSLLI(X)$_x$YYRITYGETGGNSPVQEFTV(X)$_y$ATISGLKPGV

DYTITVYAV(X)$_z$ISINYRT

As described herein for anti-PCSK9 Adnectins, SEQ ID NOs: 328 and 329 can be defined and applied to SABA molecules in the same way. In exemplary embodiments, the BC, DE, and FG loops as represented by $(X)_x$, $(X)_y$, and $(X)_z$, respectively, are replaced with polypeptides comprising the BC, DE and FG loop sequences from any of the HSA binders shown in Table 6 below (i.e., SEQ ID NOs: 330, 334, 338, 342, 346, and 348-370 in Table 6). In certain embodiments, the BC, DE, or FG loop sequences shown in Table 6 may contain one or more additional residues flanking the N- and/or C-termini. In particular, the BC loop may contain an SW at the N-terminus of the BC loop sequences shown in Table 6 when replacing $(X)_x$ in SEQ ID NO: 328. Similarly, the DE loop may contain a P preceding loop DE and the residue T following loop DE when replacing $(X)_y$ in SEQ ID NO: 328. The FG loop may contain a P following the FG loop when replacing $(X)_z$ in SEQ ID NO: 328. For example, SEQ ID NO: 330 indicates that the BC, DE, and FG loops comprise HSYYEQNS (SEQ ID NO: 638), YSQT (SEQ ID NO: 639), and YGSKYYY (SEQ ID NO: 640), respectively. However, when replacing $(X)_x$, $(X)_y$, and $(X)_z$ in SEQ ID NO: 328, i.e., the BC, DE and FG loops, the $(X)_x$ sequence may be SWHSYYEQNS (SEQ ID NO: 641), the $(X)_y$ sequence may be PYSQTT (SEQ ID NO: 642), and the $(X)_z$ sequence may be YGSKYYYP (SEQ ID NO: 643).

In certain embodiments, a SABA for use in a fusion as described herein may comprise the sequence as set forth in SEQ ID NO: 328 or 329, wherein the BC, DE, and FG loops as represented by $(X)_x$, $(X)_y$, and $(X)_z$, respectively, are replaced with a respective set of specified BC, DE and FG loops from any of the 26 core SABA sequences (i.e., SEQ ID NOs: 330, 334, 338, 342, 346, and 348-370 in Table 6), or sequences at least 75%, 80%, 85%, 90%, 95%, 97%, 98%, or 99% identical to the BC, DE and FG loop sequences of the 26 core SABA sequences. In exemplary embodiments, a SABA as described herein is defined by SEQ ID NO: 329 and has a set of BC, DE and FG loop sequences from any of the 26 core SABA sequences (i.e., SEQ ID NOs: 330, 334, 338, 342, 346, and 348-370 in Table 6), optionally with the N- and/or C-terminal additions to the loop sequences as described above. For example, SABA1 has the core sequence set forth in SEQ ID NO: 330 and comprises BC, DE, and FG loops as set forth in SEQ ID NO: 331-333, respectively. Therefore, a SABA based on the SABA1 core may comprise SEQ ID NO: 328 or 329, wherein $(X)_x$ comprises SEQ ID NO: 331, $(X)_y$ comprises SEQ ID NO: 332, and $(X)_z$ comprises SEQ ID NO: 333. In some embodiments, the sequences that replace $(X)_x$, $(X)_y$, and $(X)_z$ comprise additional residue(s) on either or both ends of the loops as described above. Similar constructs are contemplated utilizing the set of BC, DE and FG loops from the other SABA core sequences. The scaffold regions of such SABA may comprise anywhere from 0 to 20, from 0 to 15, from 0 to 10, from 0 to 8, from 0 to 6, from 0 to 5, from 0 to 4, from 0 to 3, from 0 to 2, or from 0 to 1 substitutions, conservative substitutions, deletions or additions relative to the scaffold amino acids residues of SEQ ID NO: 1. Such scaffold modifications may be made, so long as the SABA is capable of binding serum albumin, e.g., HSA, with a desired $K_D$.

In certain embodiments, a SABA (e.g., a SABA core sequence or a sequence based thereon as described above) may be modified to comprise an N-terminal extension sequence and/or a C-terminal extension sequence. Exemplary extension sequences are shown in Table 6. For example, SEQ ID NO: 420 designated as SABA1.1 comprises the core SABA 1 sequence (SEQ ID NO: 330) with an N-terminal sequence MGVSDVPRDLE (SEQ ID NO: 371, designated as AdNT1), and a C-terminal sequence EIDKPSQ (SEQ ID NO: 380, designated as AdCT1). SABA1.1 further comprises a His6 tag at the C-terminus, however, it should be understood that the His6 tag is completely optional and may be placed anywhere within the N- or C-terminal extension sequences, or may be absent from the sequence all together. Further, any of the exemplary N- or C-terminal extension sequences provided in Table 6 (SEQ ID NO: 371-395), and any variants thereof, can be used to modify any given SABA core sequence provided in Table 6.

In certain embodiments, the C-terminal extension sequences (also called "tails"), comprise E and D residues, and may be between 8 and 50, 10 and 30, 10 and 20, 5 and 10, and 2 and 4 amino acids in length. In some embodiments, tail sequences include ED-based linkers in which the sequence comprises tandem repeats of ED. In exemplary embodiments, the tail sequence comprises 2-10, 2-7, 2-5, 3-10, 3-7, 3-5, 3, 4 or 5 ED repeats. In certain embodiments, the ED-based tail sequences may also include additional amino acid residues, such as, for example: EI, EID, ES, EC, EGS, and EGC. Such sequences are based, in part, on known Adnectin tail sequences, such as EIDKPSQ (SEQ ID NO: 380), in which residues D and K have been removed. In exemplary embodiments, the ED-based tail comprises an E, I or EI residues before the ED repeats.

In other embodiments, the tail sequences may be combined with other known linker sequences (e.g., SEQ ID NO: 396-419 in Table 6) as necessary when designing a SABA fusion molecule.

Conjugation/Linkers

SABA fusions may be covalently or non-covalently linked. In some embodiments, a serum albumin binding $^{10}$Fn3 may be directly or indirectly linked to an anti-PCSK9 Adnectin via a polypeptide linker. Suitable linkers for joining Fn3 domains are those which allow the separate domains to fold independently of each other forming a three dimensional structure that permits high affinity binding to a target molecule.

The disclosure provides a number of suitable linkers that meet these requirements, including glycine-serine based linkers, glycine-proline based linkers, as well as the linker having the amino acid sequence PSTSTST (SEQ ID NO: 416). The Examples described herein demonstrate that Fn3 domains joined via polypeptide linkers retain their target binding function. In some embodiments, the linker is a glycine-serine based linker. These linkers comprise glycine and serine residues and may be between 8 and 50, 10 and 30, and 10 and 20 amino acids in length. Examples include linkers having an amino acid sequence (GS)₇ (SEQ ID NO: 403), G(GS)₆ (SEQ ID NO: 398), and G(GS)₇G (SEQ ID NO: 400). Other linkers contain glutamic acid, and include, for example, (GSE)₅ (SEQ ID NO: 405) and GGSE GGSE (SEQ ID NO: 409). Other exemplary glycine-serine linkers include (GS)₄ (SEQ ID NO: 402), (GGGGS)₇ (SEQ ID NO: 411), (GGGGS)₅ (SEQ ID NO: 412), and (GGGGS)₃G (SEQ ID NO: 413). In some embodiments, the linker is a glycine-proline based linker. These linkers comprise glycine and proline residues and may be between 3 and 30, 10 and 30, and 3 and 20 amino acids in length. Examples include linkers having an amino acid sequence (GP)₃G (SEQ ID NO: 414), (GP)₅G (SEQ ID NO: 415), and GPG. In other embodiments, the linker may be a proline-alanine based linker having between 3 and 30, 10 and 30, and 3 and 20 amino acids in length. Examples of proline alanine based linkers include, for example, (PA)₃ (SEQ ID NO: 417), (PA)₆ (SEQ ID NO: 418) and (PA)₉ (SEQ ID NO: 419). It is contemplated, that the optimal linker length and amino acid composition may be determined by routine experimentation in view of the teachings provided herein. In some embodiments, an anti-PCSK9 Adnectin is linked to a SABA via a polypeptide linker having a protease site that is cleavable by a protease in the blood or target tissue. Such embodiments can be used to release an anti-PCSK9 Adnectin for better delivery or therapeutic properties or more efficient production.

Additional linkers or spacers, may be introduced at the C-terminus of a Fn3 domain between the Fn3 domain and the polypeptide linker. Additional linkers or spacers may be introduced at the N-terminus of a Fn3 domain between the Fn3 domain and the polypeptide linker.

In some embodiments, an anti-PCSK9 Adnectin may be directly or indirectly linked to a SABA via a polymeric linker. Polymeric linkers can be used to optimally vary the distance between each component of the fusion to create a protein fusion with one or more of the following characteristics: 1) reduced or increased steric hindrance of binding of one or more protein domains when binding to a protein of interest, 2) increased protein stability or solubility, 3) decreased protein aggregation, and 4) increased overall avidity or affinity of the protein.

In some embodiments, an anti-PCSK9 Adnectin is linked to a SABA via a biocompatible polymer such as a polymeric sugar. The polymeric sugar can include an enzymatic cleavage site that is cleavable by an enzyme in the blood or target tissue. Such embodiments can be used to release an anti-PCSK9 Adnectin for better delivery or therapeutic properties or more efficient production.

Summary of Sequences

Many of the sequences referenced in "Fusions of Serum Albumin Binding Adnectin (SABA)" and "Conjugation/Linkers" sections above are summarized in Table 6 below. Unless otherwise specified, all N-terminal extensions are indicated with a single underline, all C-terminal tails/extensions are indicated with a double underline, and linker sequences are boxed. Loop regions BC, DE and FG are shaded for each core SABA sequence. As described further above, the modification sequences (e.g., N or C terminal extensions and linkers) can also be used to modify anti-PCSK9 Adnectin molecules.

TABLE 6

Summary of Exemplary Sequences

| SEQ ID | Sequence Name | Description | Sequence |
|---|---|---|---|
| | | Exemplary Serum Albumin-Binding Adnectins (SABA) | |
| 327 | ¹⁰Fn3WT core | WT core human ¹⁰Fn3 domain | EVVAATPTSLLISWDAPAVTVRYYRITYGET GGNSPVQEFTVPGSKSTATISGLKPGVDYTI TVYAVTGRGDSPASSKPISINYRT |
| 328 | ¹⁰Fn3v6 | Generic ¹⁰Fn3 having 6 variable loops | EVVAAT(X)ₐSLLI(X)ₓYYRITYGE(X)ᵦQE FTV(X)ᵧATI(X)꜀DYTITVYAV(X)ᵤISINY RT |
| 329 | ¹⁰Fn3v3 | Generic ¹⁰Fn3 having 3 variable loops | EVVAATPTSLLI(X)ₓYYRITYGETGGNSPV QEFTV(X)ᵧATISGLKPGVDYTITVYAV(X)ᵤ ISINYRT |
| 330 | SABA1 | Core 1 Adnectin | EVVAATPTSLLISWHSYYEQNSYYRITYGET GGNSPVQEFTVFYSQTTATISGLKPGVDYTI TVYAVYGSKYYYPISINYRT |
| 331 | SABA1BC | Core 1 BC Loop | HSYYEQNS |
| 332 | SABA1DE | Core 1 DE Loop | YSQT |
| 333 | SABA1FG | Core 1 FG Loop | YGSKYYY |
| 334 | SABA2 | Core 2 Adnectin | EVVAATPTSLLISWPKYDKTGHYYRITYGET GGNSPVQEFTVFTRQTTATISGLKPGVDYTI TVYAVSKDDYYPHEHRPISINYRT |
| 335 | SABA2BC | Core 2 BC Loop | PKYDKTGH |
| 336 | SABA2DE | Core 2 DE Loop | TRQT |
| 337 | SABA2FG | Core 2 FG Loop | SKDDYYPHEHR |

TABLE 6-continued

Summary of Exemplary Sequences

| SEQ ID | Sequence Name | Description | Sequence |
|---|---|---|---|
| 338 | SABA3 | Core 3 Adnectin | EVVAATPTSLLISWSNDGPGLSYYRITYGET GGNSPVQEFTVFSSQTTATISGLKPGVDYTI TVYAVSYYTKKAYSAGPISINYRT |
| 339 | SABA3BC | Core 3 BC Loop | SNDGPGLS |
| 340 | SABA3DE | Core 3 DE Loop | SSQT |
| 341 | SABA3FG | Core 3 FG Loop | SYYTKKAYSAG |
| 342 | SABA4 | Core 4 Adnectin; contains a scaffold mutation (bolded); scaffold-perfect version is SABA5 | EMVAATPTSLLISWEDDSYYSRYYRITYGET GGNSPVQEFTVFSDLYTATISGLKPGVDYTI TVYAVTYDVTDLIMHEPISINYRT |
| 343 | SABA4BC | Core 4 BC Loop | EDDSYYSR |
| 344 | SABA4DE | Core 4 DE Loop | SDLY |
| 345 | SABA4FG | Core 4 FG Loop | YDVTDLIMHE |
| 346 | SABA5 | Core 5 Adnectin; see description for SABA4; corrected residue is bolded | EVVAATPTSLLISWEDDSYYSRYYRITYGET GGNSPVQEFTVFSDLYTATISGLKPGVDYTI TVYAVTYDVTDLIMHEPISINYRT |
| 347 | SABA5BC | Core 5 BC Loop | EDDSYYSR |
| 348 | SABA5DE | Core 5 DE Loop | SDLY |
| 349 | SABA5FG | Core 5 FG Loop | YDVTDLIMHE |
| 350 | SABA6 | Core 6 Adnectin | EVVAATPTSLLISWYMDEYDVRYYRITYGET GGNSPVQEFTVFNYYNTATISGLKPGVDYTI TVYAVTRIKANNVMYGPISINYRT |
| 351 | SABA7 | Core 7 Adnectin | EVVAATPTSLLISWNHLEHVARYYRITYGET GGNSPVQEFTVFEYPTTATISGLKPGVDYTI TVYAVTITMLKYPTQSPISINYRT |
| 352 | SABA8 | Core 8 Adnectin | EVVAATPTSLLISWGHYRRSGHYYRITYGET GGNSPVQEFTVDPSSYTATISGLKPGVDYTI TVYAVSKDDYYPHEHRPISINYRT |
| 353 | SABA9 | Core 9 Adnectin | EVVAATPTSLLISWDASHYERRYYRITYGET GGNSPVQEFTVFRYHHTATISGLKPGVDYTI TVYAVTQAQEHYQPPISINYRT |
| 354 | SABA10 | Core 10 Adnectin | EVVAATPTSLLISWNSYYHSADYYRITYGET GGNSPVQEFTVFYPPTTATISGLKPGVDYTI TVYAVYSAKSYYPISINYRT |
| 355 | SABA11 | Core 11 Adnectin | EVVAATPTSLLISWSKYSKHGHYYRITYGET GGNSPVQEFTVFSGNATATISGLKPGVDYTI TVYAVEDTNDYPHTHRPISINYRT |
| 356 | SABA12 | Core 12 Adnectin | EVVAATPTSLLISWHGEPDQTRYYRITYGET GGNSPVQEFTVFPYRRTATISGLKPGVDYTI TVYAVTSGYTGHYQPISINYRT |
| 357 | SABA13 | Core 13 Adnectin | EVVAATPTSLLISWSKYSKHGHYYRITYGET GGNSPVQEFTVDPSSYTATISGLKPGVDYTI TVYAVSKDDYYPHEHRPISINYRT |
| 358 | SABA14 | Core 14 Adnectin | EVVAATPTSLLISWYEPYTPIHYYRITYGET GGNSPVQEFTVFGYYGTATISGLKPGVDYTI TVYAVYGYYQYTPISINYRT |
| 359 | SABA15 | Core 15 Adnectin | EVVAATPTSLLISWSKYSKHGHYYRITYGET |

TABLE 6-continued

Summary of Exemplary Sequences

| SEQ ID | Sequence Name | Description | Sequence |
|---|---|---|---|
| | | | GGNSPVQEFTVFSGNATATISGLKPGVDYTI TVYAVSDDNKYYHQHRPISINYRT |
| 360 | SABA16 | Core 16 Adnectin | EVVAATPTSLLISWGHYRRSGHYYRITYGET GGNSPVQEFTVDPSSYTATISGLKPGVDYTI TVYAVSKDDYYPHEHRPISINYRT |
| 361 | SABA17 | Core 17 Adnectin | EVVAATPTSLLISWSKYSKHGHYYRITYGET GGNSPVQEFTVPSGNATATISGLKPGVDYTI TVYAVEDTNDYPHTHRPISINYRT |
| 362 | SABA18 | Core 18 Adnectin | EVVAATPTSLLISWYEPGASVYYRITYGET GGNSPVQEFTVPSYYHTATISGLKPGVDYTI TVYAVYGYYEYPPISINYRT |
| 363 | SABA19 | Core 19 Adnectin | EVVAATPTSLLISWQSYYAHSDYYRITYGET GGNSPVQEFTVPYPPQTATISGLKPGVDYTI TVYAVYAGSSYYPISINYRT |
| 364 | SABA20 | Core 20 Adnectin | EVVAATPTSLLISWGHYRRSGHYYRITYGET GGNSPVQEFTVDPSSYTATISGLKPGVDYTI TVYAVSKDDYYPHEHRPISINYRT |
| 365 | SABA21 | Core 21 Adnectin | EVVAATPTSLLISWPEPGTPVYYRITYGET GGNSPVQEFTVPAYYGTATISGLKPGVDYTI TVYAVYGYYDYSPISINYRT |
| 366 | SABA22 | Core 22 Adnectin | EVVAATPTSLLISWYRYEKTQHYYRITYGET GGNSPVQEFTVPPESGTATISGLKPGVDYTI TVYAVYAGYEYPHTHRPISINYRT |
| 367 | SABA23 | Core 23 Adnectin | EVVAATPTSLLISWVKSEEYYRYYRITYGET GGNSPVQEFTVPYYVHTATISGLKPGVDYTI TVYAVTEYYYAGAVVSVPISINYRT |
| 368 | SABA24 | Core 24 Adnectin | EVVAATPTSLLISWYDPYTYGSYYRITYGET GGNSPVQEFTVGPYTTTATISGLKPGVDYTI TVYAVSYYYSTQPISINYRT |
| 369 | SABA25 | Core 25 Adnectin | EVVAATPTSLLISWSNDGPGLSYYRITYGET GGNSPVQEFTVPSSQTTATISGLKPGVDYTI TVYAVSYYTKKAYSAGPISINYRT |
| 370 | SABA26 | Core 26 Adnectin | EVVAATPTSLLISWPDPYYKPDYYRITYGET GGNSPVQEFTVPRDYTTATISGLKPGVDYTI TVYAVYSYYGYYPISINYRT |

Exemplary Adnectin N-Terminal Extension Sequences

| SEQ ID | Sequence Name | Description | Sequence |
|---|---|---|---|
| 371 | AdNT1 | Exemplary leader | MGVSDVPRDL |
| 372 | AdNT2 | Exemplary leader | GVSDVPRDL |
| 373 | AdNT3 | Exemplary leader | VSDVPRDL |
| 374 | AdNT4 | Exemplary leader | SDVPRDL |
| 375 | AdNT5 | Exemplary leader | DVPRDL |
| 376 | AdNT6 | Exemplary leader | VPRDL |
| 377 | AdNT7 | Exemplary leader | PRDL |
| 378 | AdNT8 | Exemplary leader | RDL |
| 379 | AdNT9 | Exemplary leader | DL |

Exemplary Adnectin C-Terminal Extension Sequences

| SEQ ID | Sequence Name | Description | Sequence |
|---|---|---|---|
| 380 | AdCT1 | Exemplary tail | EIDKPSQ |

TABLE 6-continued

Summary of Exemplary Sequences

| SEQ ID | Sequence Name | Description | Sequence |
|---|---|---|---|
| 381 | AdCT2 | Exemplary tail | EIDKPS |
| 382 | AdCT3 | Exemplary tail | EIDKPC |
| 383 | AdCT4 | Exemplary tail | EIDKP |
| 384 | AdCT5 | Exemplary tail | EIDK |
| 385 | AdCT6 | Exemplary tail | EI |
| 386 | AdCT7 | Exemplary tail | EIEKPSQ |
| 387 | AdCT8 | Exemplary tail | EIDKPSQLE |
| 388 | AdCT9 | Exemplary tail | EIEDEDEDED |
| 389 | AdCT10 | Exemplary tail | EIEKPSQEDEDEDEDED |
| 390 | AdCT11 | Exemplary tail | EGSGS |
| 391 | AdCT12 | Exemplary tail | EIDKPCQ |
| 392 | AdCT13 | Exemplary tail | EIEKPCQ |
| 393 | AdCT14 | Exemplary tail | GSGC |
| 394 | AdCT15 | Exemplary tail | EGSGC |
| 395 | AdCT16 | Exemplary tail | EIDKPCQLE |
| 396 | L1 | $G(GS)_2$ | GGSGS |
| 397 | L2 | $G(GS)_4$ | GGSGSGSGS |
| 398 | L3 | $G(GS)_6$ | GGSGSGSGSGSGS |
| 399 | L4 | $G(GS)_7$ | GGSGSGSGSGSGSGS |
| 400 | L5 | $G(GS)_7G$ | GGSGSGSGSGSGSGSG |
| 401 | L6 | GSGS | GSGS |
| 402 | L7 | $(GS)_4$ | GSGSGSGS |
| 403 | L7 | $(GS)_7$ | GSGSGSGSGSGSGS |
| 404 | L9 | $GS(A)_9GS$ | GSAAAAAAAAAGS |
| 405 | L10 | $(GSE)_5$ | GSEGSEGSEGSEGSE |
| 406 | L11 | $(PAS)_5$ | PASPASPASPASPAS |
| 407 | L12 | $(GSP)_5$ | GSPGSPGSPGSPGSP |
| 408 | L13 | $GS(TVAAPS)_2$ | GSTVAAPSTVAAPS |
| 409 | L14 | $(GGSE)_2$ | GGSEGGSE |
| 410 | L15 | $(ST)_3G$ | STSTSTG |
| 411 | L16 | $(GGGGS)_7$ | GGGGSGGGGSGGGGSGGGGSGGGGSGGGGSGGGGS |
| 412 | L17 | $(GGGGS)_5$ | GGGGSGGGGSGGGGSGGGGSGGGGS |
| 413 | L18 | $(GGGGS)_3G$ | GGGGSGGGGSGGGGSG |
| 414 | L19 | $(GP)_3G$ | GPGPGPG |
| 415 | L20 | $(GP)_5G$ | GPGPGPGPGPG |
| 416 | L21 | $P(ST)_3$ | PSTSTST |
| 417 | L22 | $(PA)_3$ | PAPAPA |

TABLE 6-continued

Summary of Exemplary Sequences

| SEQ ID | Sequence Name | Description | Sequence |
|---|---|---|---|
| 418 | L23 | (PA)₆ | PAPAPAPAPAPA |
| 419 | L24 | (PA)₉ | PAPAPAPAPAPAPAPAPA |

Exemplary Extensions to Adnectin Core Sequences

| SEQ ID | Sequence Name | Description | Sequence |
|---|---|---|---|
| 420 | SABA1.1 | Adnectin core 1 sequence having AdNT1 and AdCT1 terminal sequences with His6 tag | MGVSDVPRDLEVVAATPTSLLISWHSYYEQN SYYRITYGETGGNSPVQEFTVPYSQTTATIS GLKPGVDYTITVYAVYGSKYYYPISINYRTE IDKPSQHHHHHH |
| 421 | SABA1.2 | Adnectin core 1 sequence having AdNT1 and AdCT8 terminal sequences | MGVSDVPRDLEVVAATPTSLLISWHSYYEQN SYYRITYGETGGNSPVQEFTVPYSQTTATIS GLKPGVDYTITVYAVYGSKYYYPISINYRTE IEDEDEDED |
| 422 | SABA1.3 | Adnectin core 1 sequence having AdNT1 and AdCT9 terminal sequences with His6 tag | MGVSDVPRDLEVVAATPTSLLISWHSYYEQN SYYRITYGETGGNSPVQEFTVPYSQTTATIS GLKPGVDYTITVYAVYGSKYYYPISINYRTE IEDEDEDEDHHHHHH |
| 423 | SABA2.1 | Adnectin core 2 sequence having AdNT1 and AdCT1 terminal sequences with His6 tag | MGVSDVPRDLEVVAATPTSLLISWPKYDKTG HYYRITYGETGGNSPVQEFTVPTRQTTATIS GLKPGVDYTITVYAVSKDDYYPHEHRPISIN YRTEIDKPSQHHHHHH |
| 424 | SABA3.1 | Adnectin core 3 sequence having AdNT1 and AdCT1 terminal sequences with His6 tag | MGVSDVPRDLEVVAATPTSLLISWSNDGPGL SYYRITYGETGGNSPVQEFTVPSSQTTATIS GLKPGVDYTITVYAVSYYTKKAYSAGPISIN YRTEIDKPSQHHHHHH |
| 425 | SABA4.1 | Adnectin core 4 sequence having AdNT1 and AdCT1 terminal sequences with His6 tag | MGVSDVPRDLEMVAATPTSLLISWEDDSYYS RYYRITYGETGGNSPVQEFTVPSDLYTATIS GLKPGVDYTITVYAVTYDVTDLIMHEPISIN YRTEIDKPSQHHHHHH |
| 426 | SABA5.1 | Adnectin core 5 sequence having AdNT1 and AdCT1 terminal sequences with His6 tag | MGVSDVPRDLEVVAATPTSLLISWEDDSYYS RYYRITYGETGGNSPVQEFTVPSDLYTATIS GLKPGVDYTITVYAVTYDVTDLIMHEPISIN YRTEIDKPSQHHHHHH |
| 427 | SABA6.1 | Adnectin core 6 sequence having AdNT1 and AdCT1 terminal sequences with His6 tag | MGVSDVPRDLEVVAATPTSLLISWYMDEYDV RYYRITYGETGGNSPVQEFTVPNYYNTATIS GLKPGVDYTITVYAVTRIKANNYMYGPISIN YRTEIDKPSQHHHHHH |
| 428 | SABA7.1 | Adnectin core 7 sequence having AdNT1 and AdCT1 terminal sequences with His6 tag | MGVSDVPRDLEVVAATPTSLLISWNHLEHVA RYYRITYGETGGNSPVQEFTVPEYPTTATIS GLKPGVDYTITVYAVTITMLKYPTQSPISIN YRTEIDKPSQHHHHHH |
| 429 | SABA8.1 | Adnectin core 8 sequence having AdNT1 and AdCT1 terminal sequences with His6 tag | MGVSDVPRDLEVVAATPTSLLISWGHYRRSG HYYRITYGETGGNSPVQEFTVDPSSYTATIS GLKPGVDYTITVYAVSKDDYYPHEHRPISIN YRTEIDKPSQHHHHHH |
| 430 | SABA9.1 | Adnectin core 9 sequence having AdNT1 and AdCT1 terminal sequences with His6 tag | MGVSDVPRDLEVVAATPTSLLISWDASHYER RYYRITYGETGGNSPVQEFTVPRYHHTATIS GLKPGVDYTITVYAVTQAQEHYQPPISINYR TEIDKPSQHHHHHH |
| 431 | SABA10.1 | Adnectin core 10 sequence having AdNT1 and AdCT1 terminal sequences with His6 tag | MGVSDVPRDLEVVAATPTSLLISWNSYYHSA DYYRITYGETGGNSPVQEFTVPYPPTTATIS GLKPGVDYTITVYAVYSAKSYYPISINYRTE IDKPSQHHHHHH |
| 432 | SABA11.1 | Adnectin core 11 sequence having AdNT1 and AdCT1 terminal sequences with His6 tag | MGVSDVPRDLEVVAATPTSLLISWSKYSKHG HYYRITYGETGGNSPVQEFTVPSGNATATIS GLKPGVDYTITVYAVEDTNDYPHTHRPISIN YRTEIDKPSQHHHHHH |
| 433 | SABA12.1 | Adnectin core 12 sequence having AdNT1 | MGVSDVPRDLEVVAATPTSLLISWHGEPDQT RYYRITYGETGGNSPVQEFTVPPYRRTATIS |

TABLE 6-continued

Summary of Exemplary Sequences

| SEQ ID | Sequence Name | Description | Sequence |
|---|---|---|---|
| | | and AdCT1 terminal sequences with His6 tag | GLKPGVDYTITVYAVTSGYTGHYQPISINYR TEIDKPSQHHHHHH |
| 434 | SABA13.1 | Adnectin core 13 sequence having AdNT1 and AdCT1 terminal sequences with His6 tag | MGVSDVPRDLEVVAATPTSLLISWSKYSKHG HYYRITYGETGGNSPVQEFTVDPSSYTATIS GLKPGVDYTITVYAVSKDDYYPHEHRPISIN YRTEIDKPSQHHHHHH |
| 435 | SABA14.1 | Adnectin core 14 sequence having AdNT1 and AdCT1 terminal sequences with His6 tag | MGVSDVPRDLEVVAATPTSLLISWYEPYTPI HYYRITYGETGGNSPVQEFTVPGYYGTATIS GLKPGVDYTITVYAVYGYYQYTPISINYRTE IDKPSQHHHHHH |
| 436 | SABA15.1 | Adnectin core 15 sequence having AdNT1 and AdCT1 terminal sequences with His6 tag | MGVSDVPRDLEVVAATPTSLLISWSKYSKHG HYYRITYGETGGNSPVQEFTVPSGNATATIS GLKPGVDYTITVYAVSDDNKYYHQRPISIN YRTEIDKPSQHHHHHH |
| 437 | SABA16.1 | Adnectin core 16 sequence having AdNT1 and AdCT1 terminal sequences with His6 tag | MGVSDVPRDLEVVAATPTSLLISWGHYRRSG HYYRITYGETGGNSPVQEFTVDPSSYTATIS GLKPGVDYTITVYAVSKDDYYPHEHRPISIN YRTEIDKPSQHHHHHH |
| 438 | SABA17.1 | Adnectin core 17 sequence having AdNT1 and AdCT1 terminal sequences with His6 tag | MGVSDVPRDLEVVAATPTSLLISWSKYSKHG HYYRITYGETGGNSPVQEFTVPSGNATATIS GLKPGVDYTITVYAVEDTNDYPHTHRPISIN YRTEIDKPSQHHHHHH |
| 439 | SABA18.1 | Adnectin core 18 sequence having AdNT1 and AdCT1 terminal sequences with His6 tag | MGVSDVPRDLEVVAATPTSLLISWYEPGASV YYYRITYGETGGNSPVQEFTVPSYYHTATIS GLKPGVDYTITVYAVYGYYEYEPISINYRTE IDKPSQHHHHHH |
| 440 | SABA19.1 | Adnectin core 19 sequence having AdNT1 and AdCT1 terminal sequences with His6 tag | MGVSDVPRDLEVVAATPTSLLISWQSYYAHS DYYRITYGETGGNSPVQEFTVPYPPQTATIS GLKPGVDYTITVYAVYAGSSYYPISINYRTE IDKPSQHHHHHH |
| 441 | SABA20.1 | Adnectin core 20 sequence having AdNT1 and AdCT1 terminal sequences with His6 tag | MGVSDVPRDLEVVAATPTSLLISWGHYRRSG HYYRITYGETGGNSPVQEFTVDPSSYTATIS GLKPGVDYTITVYAVSKDDYYPHEHRPISIN YRTEIDKPSQHHHHHH |
| 442 | SABA21.1 | Adnectin core 21 sequence having AdNT1 and AdCT1 terminal sequences with His6 tag | MGVSDVPRDLEVVAATPTSLLISWPEPGTPV YYYRITYGETGGNSPVQEFTVPAYYGTATIS GLKPGVDYTITVYAVYGYYDYSPISINYRTE IDKPSQHHHHHH |
| 443 | SABA22.1 | Adnectin core 22 sequence having AdNT1 and AdCT1 terminal sequences with His6 tag | MGVSDVPRDLEVVAATPTSLLISWYRYEKTQ HYYRITYGETGGNSPVQEFTVPPESGTATIS GLKPGVDYTITVYAVYAGYEYPHTHRPISIN YRTEIDKPSQHHHHHH |
| 444 | SABA23.1 | Adnectin core 23 sequence having AdNT1 and AdCT1 terminal sequences with His6 tag | MGVSDVPRDLEVVAATPTSLLISWVKSEEYY RYYRITYGETGGNSPVQEFTVPYYVHTATIS GLKPGVDYTITVYAVTEYYYAGAVVSVPISI NYRTEIDKPSQHHHHHH |
| 445 | SABA24.1 | Adnectin core 24 sequence having AdNT1 and AdCT1 terminal sequences with His6 tag | MGVSDVPRDLEVVAATPTSLLISWYDPYTYG SYYRITYGETGGNSPVQEFTVGPYTTTATIS GLKPGVDYTITVYAVSYYYSTQPISINYRTE IDKPSQHHHHHH |
| 446 | SABA25.1 | Adnectin core 25 sequence having AdNT1 and AdCT1 terminal sequences with His6 tag | MGVSDVPRDLEVVAATPTSLLISWSNDGPGL SYYRITYGETGGNSPVQEFTVPSSQTTATIS GLKPGVDYTITVYAVSYYTKKAYSAGPISIN YRTEIDKPSQHHHHHH |
| 447 | SABA26.1 | Adnectin core 26 sequence having AdNT1 and AdCT1 terminal sequences with His6 tag | MGVSDVPRDLEVVAATPTSLLISWPDPYYKP DYYRITYGETGGNSPVQEFTVPRDYTTATIS GLKPGVDYTITVYAVYSYYGYYPISINYRTE IDKPSQHHHHHH |

EXAMPLES

Example 1

Material and Methods Used Herein

High Throughput Protein Production (HTPP)

Selected binders cloned into pET9d vector and transformed into *E. coli* HMS174 cells were inoculated in 5 ml LB medium containing 50 µg/mL kanamycin in a 24-well format and grown at 37° C. overnight. Fresh 5 ml LB medium (50 µg/mL kanamycin) cultures were prepared for inducible expression by aspiration 200 µl from the overnight culture and dispensing it into the appropriate well. The cultures were grown at 37° C. until $A_{600}$ 0.6-0.9. After induction with 1 mM isopropyl-β-thiogalactoside (IPTG) the culture was expressed for 6 hours at 30° C. and harvested by centrifugation for 10 minutes at 2750 g at 4° C.

Cell pellets (in 24-well format) were lysed by resuspension in 450 µl of Lysis buffer (50 mM $NaH_2PO_4$, 0.5 M NaCl, 1× Complete Protease Inhibitor Cocktail-EDTA free (Roche), 1 mM PMSF, 10 mM CHAPS, 40 mM Imidazole, 1 mg/ml lysozyme, 30 ug/ml DNAse, 2 µg/ml aprotonin, pH 8.0) and shaken at room temperature for 1-3 hours. Lysates were clarified and re-racked into a 96-well format by transfer into a 96-well Whatman GF/D UNIFILTER® fitted with a 96-well, 1.2 ml catch plate and filtered by positive pressure. The clarified lysates were transferred to a 96-well Ni-Chelating Plate that had been equilibrated with equilibration buffer (50 mM $NaH_2PO_4$, 0.5 M NaCl, 40 mM Imidazole, pH 8.0) and was incubated for 5 min. Unbound material was removed by vacuum. The resin was washed 2×0.3 ml/well with Wash buffer #1 (50 mM $NaH_2PO_4$, 0.5 M NaCl, 5 mM CHAPS, 40 mM Imidazole, pH 8.0) with each wash removed by vacuum. Prior to elution each well was washed with 50 µl Elution buffer (PBS+20 mM EDTA), incubated for 5 min and this wash was discarded by vacuum. Protein was eluted by applying an additional 100 µl of Elution buffer to each well. After a 30 minute incubation at room temperature the plate(s) were centrifuged for 5 minutes at 200 g and eluted protein is collected in 96-well catch plates containing 5 µl of 0.5M $MgCl_2$ added to the bottom of elution catch plate prior to elution. Eluted protein was quantified using a BCA assay with SGE as the protein standard.

Midscale Expression and Purification of Insoluble Fibronectin-Based Scaffold Protein Binders For expression of insoluble clones, the clone(s), followed by the $HIS_6$tag, are cloned into a pET9d (EMD Bioscience, San Diego, Calif.) vector and are expressed in *E. coli* HMS174 cells. Twenty ml of an inoculum culture (generated from a single plated colony) is used to inoculate 1 liter of LB medium containing 50 µg/ml carbenicillin and 34 µg/ml chloromphenicol. The culture is grown at 37° C. until $A_{600}$ 0.6-1.0. After induction with 1 mM isopropyl-β-thiogalactoside (IPTG) the culture is grown for 4 hours at 30° C. and is harvested by centrifugation for 30 minutes at ≥10,000 g at 4° C. Cell pellets are frozen at −80° C. The cell pellet is resuspended in 25 ml of lysis buffer (20 mM $NaH_2PO_4$, 0.5 M NaCl, 1× Complete Protease Inhibitor Cocktail-EDTA free (Roche), 1 mM PMSF, pH 7.4) using an ULTRA-TURRAX® homogenizer (IKA works) on ice. Cell lysis is achieved by high pressure homogenization (≥18,000 psi) using a Model M-110S MICROFLUIDIZER® (Microfluidics). The insoluble fraction is separated by centrifugation for 30 minutes at 23,300 g at 4° C. The insoluble pellet recovered from centrifugation of the lysate is washed with 20 mM sodium-phosphate/500 mM NaCl, pH7.4. The pellet is resolubilized in 6.0M guanidine hydrochloride in 20 mM sodium phosphate/500M NaCl pH 7.4 with sonication followed by incubation at 37 degrees for 1-2 hours. The resolubilized pellet is filtered to 0.45 µm and loaded onto a Histrap column equilibrated with the 20 mM sodium phosphate/500M NaCl/6.0M guanidine pH 7.4 buffer. After loading, the column is washed for an additional 25 CV with the same buffer. Bound protein is eluted with 50 mM Imidazole in 20 mM sodium phosphate/500 mM NaCl/6.0M guan-HCl pH7.4. The purified protein is refolded by dialysis against 50 mM sodium acetate/150 mM NaCl pH 4.5.

Midscale Expression and Purification of Soluble Fibronectin-Base Scaffold Protein Binders For expression of soluble clones, the clone(s), followed by the $HIS_6$tag, were cloned into a pET9d (EMD Bioscience, San Diego, Calif.) vector and were expressed in *E. coli* HMS174 cells. Twenty ml of an inoculum culture (generated from a single plated colony) was used to inoculate 1 liter of LB medium containing 50 µg/ml carbenicillin and 34 µg/ml chloromphenicol. The culture was grown at 37° C. until $A_{600}$ 0.6-1.0. After induction with 1 mM isopropyl-β-thiogalactoside (IPTG), the culture was grown for 4 hours at 30° C. and was harvested by centrifugation for 30 minutes at ≥10,000 g at 4° C. Cell pellets were frozen at −80° C. The cell pellet was resuspended in 25 ml of lysis buffer (20 mM $NaH_2PO_4$, 0.5 M NaCl, 1× Complete Protease Inhibitor Cocktail-EDTA free (Roche), 1 mM PMSF, pH 7.4) using an ULTRA-TURRAX® homogenizer (IKA works) on ice. Cell lysis was achieved by high pressure homongenization (≥18,000 psi) using a Model M-110S MICROFLUIDIZER® (Microfluidics). The soluble fraction was separated by centrifugation for 30 minutes at 23,300 g at 4° C. The supernatant was clarified via 0.45 µm filter. The clarified lysate was loaded onto a Histrap column (GE) pre-equilibrated with the 20 mM sodium phosphate/500M NaCl pH 7.4. The column was then washed with 25 column volumes of the same buffer, followed by 20 column volumes of 20 mM sodium phosphate/500M NaCl/25 mM Imidazole, pH 7.4 and then 35 column volumes of 20 mM sodium phosphate/500M NaCl/40 mM Imidazole, pH 7.4. Protein was eluted with 15 column volumes of 20 mM sodium phosphate/500M NaCl/500 mM Imidazole, pH 7.4, fractions were pooled based on absorbance at $A_{280}$ and were dialyzed against 1×PBS, 50 mM Tris, 150 mM NaCl. pH 8.5 or 50 mM NaOAc; 150 mM NaCl; pH4.5. Any precipitate was removed by filtering at 0.22 µm.

Example 2

In Vitro Nonclinical Pharmacology $K_D$ by SPR

The binding characteristics were characterized by Surface Plasmon Resonance (SPR). Human PCSK9 and Cynomolgus PCSK9 were immobilized on separate channels on one dimension of a ProteOn XPR (Bio-Rad) chip surfaces and exposed to 6 different concentrations of 2013E01 in the other dimension of the same SPR chip surface. This allowed kinetic determination in the absence of regeneration. Duplicate chips were used for kinetic determinations of the Human and Cynomolgus PCSK9 at 25° C. Evaluation of the kinetic parameters was performed using the Langmuir interaction model and constant parameter fitting with the ProteOn Manager software.

Under these conditions, anti-PCSK9 Adnectins bound to human PCSK9 with dissociation constants ($K_D$) ranging from 80 pM to 1.6 nM and to the cyno PCSK9 with dissociation constants ($K_D$) ranging from 8 nM to 24 nM (Table 7). Association rates were approximately $10^5$ $M^{-1}s^{-1}$, coupled with dissociations that were typically $10^{-3}$-$10^{-5}$ $s^{-1}$. For some Adnectins, the off-rates from human PCSK9 were slow (on the order of $10^{-5}$ $s^{-1}$), which is close to the limit of detection for SPR technologies so it is possible that these dissociation constant measurements from human PCSK9 are under-estimates.

TABLE 7

SPR-Determined Kinetic Parameters for Anti-PCSK9 Adnectins Against Directly Immobilized Human and Cyno PCSK9

| Clone ID | PCSK9 Species | $k_{on}$ ($M^{-1}s^{-1}$) | $k_{off}$ ($s^{-1}$) | $K_D$ (nM) |
|---|---|---|---|---|
| 1459D05 | human | 1.13E+05 | 1.80E−04 | 1.58 ± 0.176 |
| 2013E01 | human | 7.03 ± 0.1E+05 | 2.42 ± 0.3E−05 | 0.292 ± 0.008 |
| 2013E01 | cyno | 2.19E+05 | 1.77E−03 | 8.1 |
| 1922G04 | human | 5.41E+05 | 5.08E−05 | 0.094 ± 0.009 |
| 1922G04 | cyno | 4.65E+05 | 7.00E−03 | 15.03 |
| 2011H05 | human | 1.18E+05 | 9.76E−06 | 0.079 ± 0.038 |
| 2011H05 | cyno | 1.90E+05 | 4.40E−03 | 23.1 |
| 2012A04 | human | 2.59E+05 | 6.47E−05 | 0.251 ± 0.011 |
| 2012A04 | cyno | 1.95E+05 | 4.75E−03 | 24.32 |

$K_D$ by BLI

The binding characteristics of Adnectins and human PCSK9 were also determined by Bio-Layer Interferometry (BLI). Biotinylated human PCSK9 was immobilized onto superstreptavidin sensor tips which were subsequently immersed into wells containing diluted Adnectin for the duration of the association phase. Tips were then immersed into a buffer-only well for observation of Adnectin dissociation. Experiments were performed in a temperature controlled environment at either 25 or 37° C., and the oscillation speed was set at 1500 rpm.

Binding interaction analysis was performed using proprietary software from Fortebio (Fortebio Data Analysis Software version 6.3.0.36). Global fits were performed for all samples, using a 1:1 binding model. The nature of these global fits constrained all values of concentration to a single pair of association and dissociation rates that were themselves constrained to each other. Affinities ($K_D$), association and dissociation rates were averaged over the various loading levels used in the analysis. Under these conditions, Adnectins bound human PCSK9 with affinities ranging from 200 pM to 7.5 nM, as shown in Table 8 below. Association rates ranged from $10^4$-$10^5$ $M^{-1}s^{-1}$, and coupled with dissociations that were typically $10^{-3}$-$10^{-5}$ $s^{-1}$.

TABLE 8

BLI-Determined Kinetic Parameters for PCSK9 Adnectins Against Human PCSK9

| Clone ID or ATI# | $k_{on}$ ($M^{-1}s^{-1}$) | $k_{off}$ ($s^{-1}$) | $K_D$ (nM) |
|---|---|---|---|
| 2381D04 | 2.66E+05 ± 6.4E+04 | 6.90E−05 ± 6.9E−05 | 0.237 ± 0.08 |
| 2382D09 | 5.33E+05 | 1.64E−04 | 0.304 |
| 2382D05 | 5.05E+05 ± 2.0E+05 | 1.57E−04 ± 4.2E−05 | 0.314 ± 0.06 |
| 2381B04 | 3.09E+05 ± 2.1E+04 | 1.60E−04 ± 1.6E−04 | 0.527 ± 0.11 |
| 2382E05 | 4.36E+05 ± 1.6E+05 | 2.50E−04 ± 1.1E−05 | 0.604 ± 0.21 |
| 2382B09 | 4.51E+05 ± 4.7E+04 | 2.91E−04 ± 4.0E−05 | 0.656 ± 0.02 |
| 2382H03 | 4.71E+05 ± 1.4E+05 | 5.57E−04 ± 2.3E−04 | 0.677 ± 0.02 |
| 2382C09 | 3.49E+05 | 2.33E−04 | 0.757 |

TABLE 8-continued

BLI-Determined Kinetic Parameters for PCSK9 Adnectins Against Human PCSK9

| Clone ID or ATI# | $k_{on}$ ($M^{-1}s^{-1}$) | $k_{off}$ ($s^{-1}$) | $K_D$ (nM) |
|---|---|---|---|
| 2971A03 | 5.74E+05 | 4.20E−04 | 0.806 |
| 2382G04 | 4.19E+05 | 4.64E−04 | 1.11 |
| 2381G09 | 2.71E+05 | 2.91E−04 | 1.12 |
| 2451C06 | 3.47E+05 ± 5.4E+04 | 4.35E−04 ± 5.4E+04 | 1.27 ± 0.14 |
| 2382H10 | 2.88E+05 | 3.82E−04 | 1.40 |
| 2013E01 | 5.46E+05 | 8.37E−04 | 1.51 |
| 2382D03 | 3.54E+05 | 6.63E−04 | 1.53 |
| 2381F11 | 3.23E+05 | 5.22E−04 | 1.59 |
| 2971E02 | 3.55E+05 | 5.55E−04 | 1.78 |
| 2382H09 | 2.51E+05 | 4.83E−04 | 1.86 |
| 2451H07 | 4.48E+05 | 9.40E−04 | 2.08 |
| 2382B10 | 3.94E+05 | 9.77E−04 | 2.35 |
| 2382C05 | 3.68E+05 | 8.79E−04 | 2.49 |
| 2971A09 | 3.99E+05 | 1.05E−03 | 2.79 |
| 2382E03 | 2.20E+05 | 5.96E−04 | 2.94 |
| 2381H09 | 1.36E+05 | 4.60E−04 | 3.23 |
| 2381B02 | 2.65E+05 | 8.31E−04 | 3.29 |
| 2381B08 | 2.13E+05 | 9.40E−04 | 4.11 |
| 2382F05 | 2.44E+05 | 1.09E−03 | 4.54 |
| 1459D05 | 1.49E+05 ± 2.5E+04 | 2.02E−03 ± 2.0E−03 | 14.4 ± 0.2 |
| ATI 1091 | 2.863E+05 | 8.201E−05 | 0.293 |
| ATI001117 | 1.451E+05 | 5.074E−05 | 0.554 |
| ATI001057 | 5.325E+05 | 1.403E−04 | 0.255 |
| ATI001119 | 8.190E+04 | 4.450E−04 | 5.296 |
| ATI001168[1] | 5.829E+05 | 3.335E−04 | 0.586 |
| ATI001175[2] | 6.558E+05 | 3.522E−04 | 0.543 |
| ATI 1081 | 8.29E+05 ± 8.1E+05 | 3.49E−04 ± 3E−04 | 0.479 ± 0.11 |
| ATI891 | 1.08E+05 | 4.03E−04 | 3.56 |
| ATI1114 | 8.072E+04 | 3.952E−04 | 4.876 |
| ATI1174 | 1.265E+05 | 9.012E−04 | 7.397 |

[1]ATI001168 is a deimmunized version of 1922G04 having an R23E substitution.
[2]ATI001175 is a deimmunized version of 1922G04 having an R23D substitution.

Solution Phase Affinity

KinExA

The solution affinities of ATI001081 and ATI001174 for human PCSK9 were measured using a Kinetic Exclusion Assay (KinExA). The relative unbound Adnectin concentrations were measured by capture on a hPCSK9 solid matrix followed by detection with a fluorescently labeled antibody that recognizes the Adnectin scaffold. Due to technical limitations, the lowest concentration of Adnectins that could be tested was 1 nM. The global $K_D$ analyses estimate a $K_D$=70 pM (28-127 pM within a 95% confidence interval) for ATI001081 and a $K_D$=223 pM for ATI001174 (range of 54-585 pM within 95% confidence interval).

TABLE 9

Solution Phase Affinity Measurements for PCSK9 Adnectins

| | ATI001081 | ATI001174 |
|---|---|---|
| $K_D$ | 69.5 pM | 223 pM |
| | 95% confidence interval: | |
| Kd high | 127 pM | 585 pM |
| Kd low | 28 pM | 54 pM |

Figure 13:
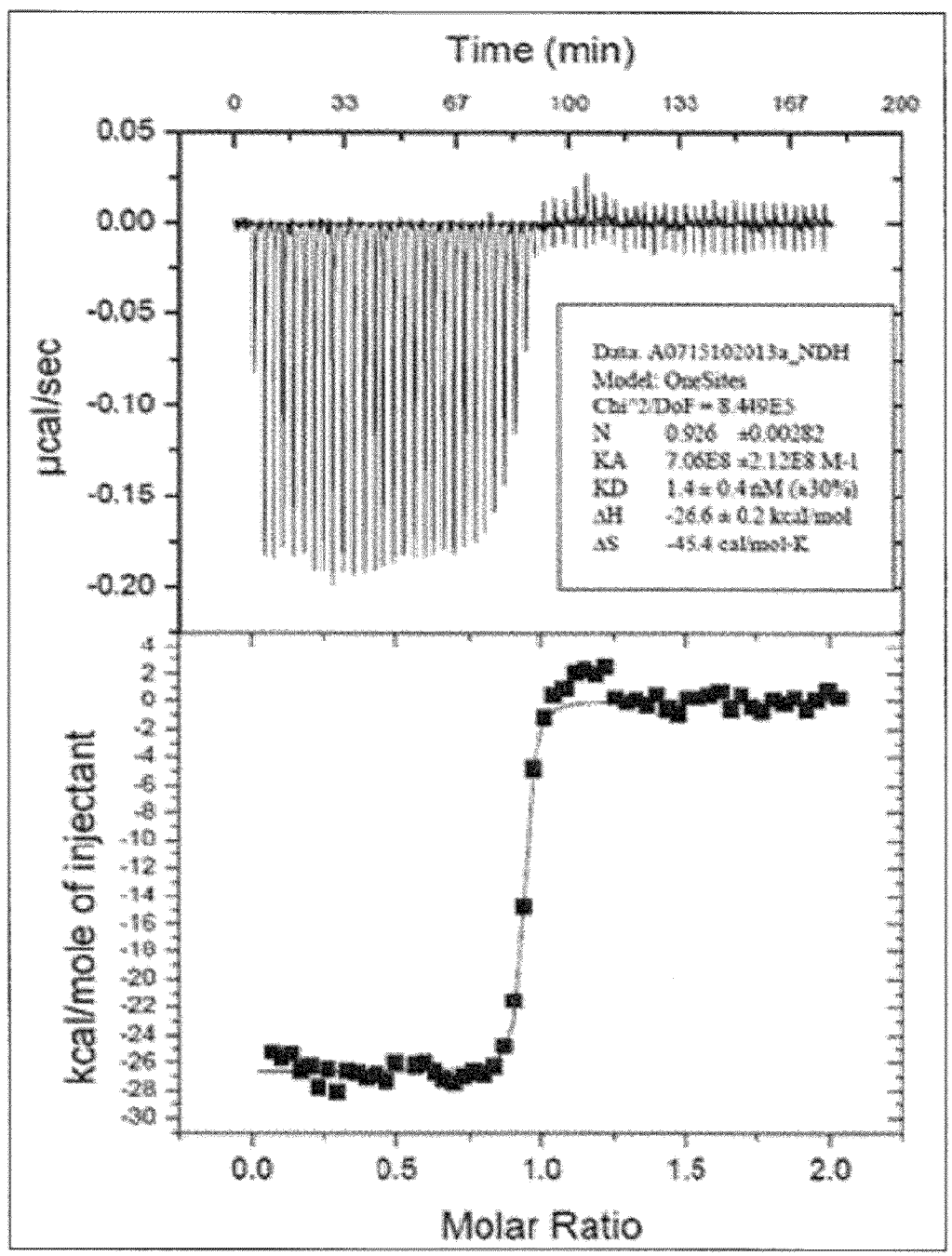
FIG. 13. ITC determination of PCSK9 Adnectin affinity and stoichiometry of binding to hPCSK9. PCSK9 Adnectins bind hPCSK9 with 1:1 stoichiometry. The left panel shows data for PCSK9 Adnectin ATI001081; the right panel shows data for PCSK9 Adnectin ATI001174.
Figure 13:
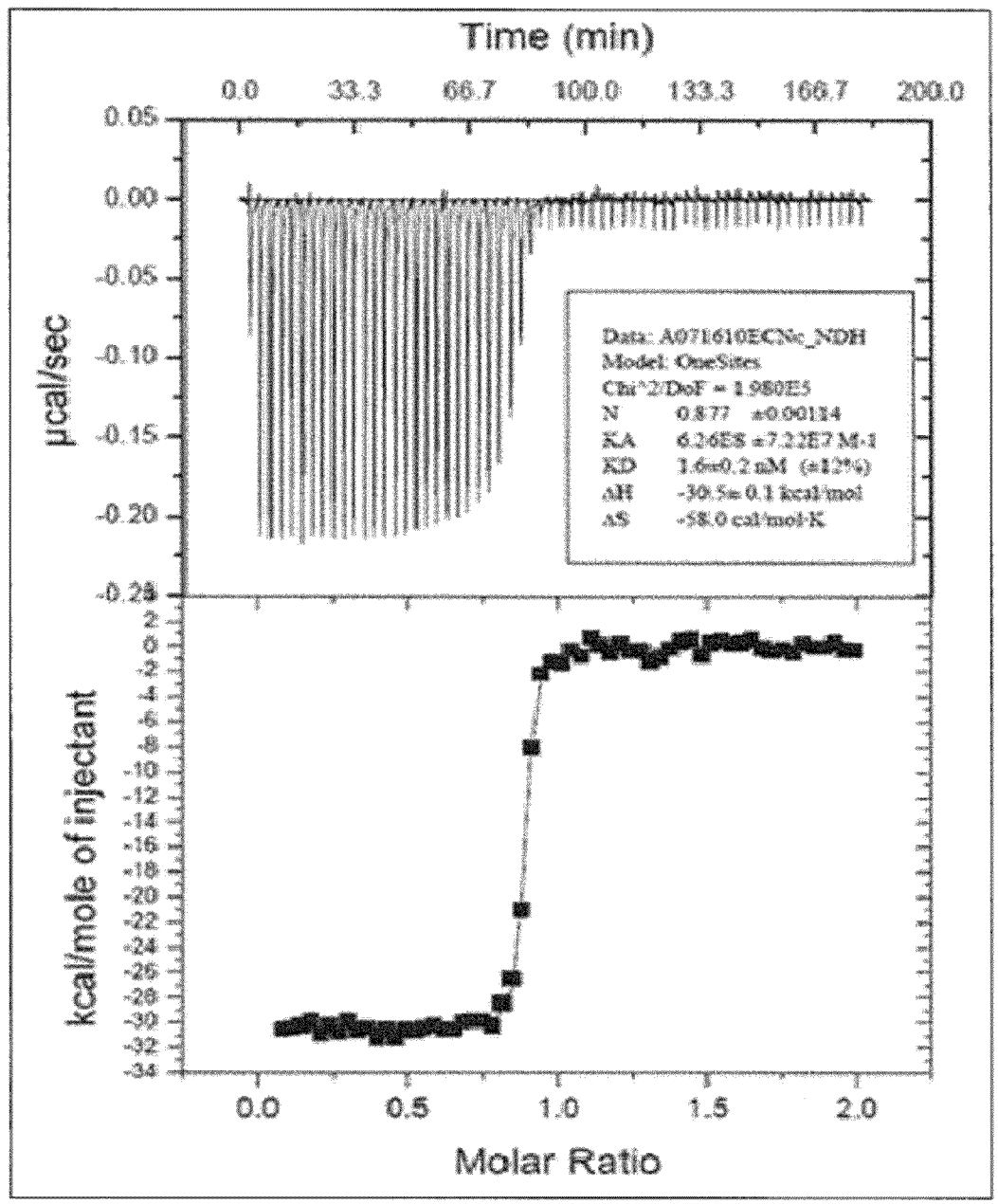

The thermodynamics and stoichiometry of binding of Adnectins ATI001174 and ATI001081 to human PCSK9 were characterized by isothermal titration calorimetry (ITC). Solution phase binding was measured in 25 mM HEPES, pH 7.41, 150 mM NaCl at 37° C. An average unimolecular binding constant of 1.3±0.2 nM was observed for ATI001174 and 1.4±0.4 nM for ATI001081. Detailed thermodynamic analyses are shown in Table 10 and FIG. 13. The difference in observed enthalpies (−3.3 kcal/mol) for the two Adnectins suggests that ATI001174 incurs an order of magnitude reduction in its affinity for PCSK9 due to PEGylation that is at least partially offset by the corresponding difference in entropy (−10.4 cal/mol·K).

TABLE 10

| Adnectin | Stoichiometry (N) | $K_A$ (M$^{-1}$) | $K_D$ (nM) | $\Delta H$ (kcal/mol) | $\Delta S$ (cal/mol °C.) |
|---|---|---|---|---|---|
| ATI001081 | 0.926 | 7.1E8 ± 2.1E8 | 1.4 ± 0.4 (±30%) | −26.6 ± 0.2 | −45.4 |
| ATI001174* | 0.857 | 7.5E8 ± 1.5E8 | 1.3 ± 0.2 | −29.9 ± 0.1 | −55.8 |

*Average of 3 experiments

Fluorescence Resonance Energy Transfer (FRET) Assay

Figure 3:
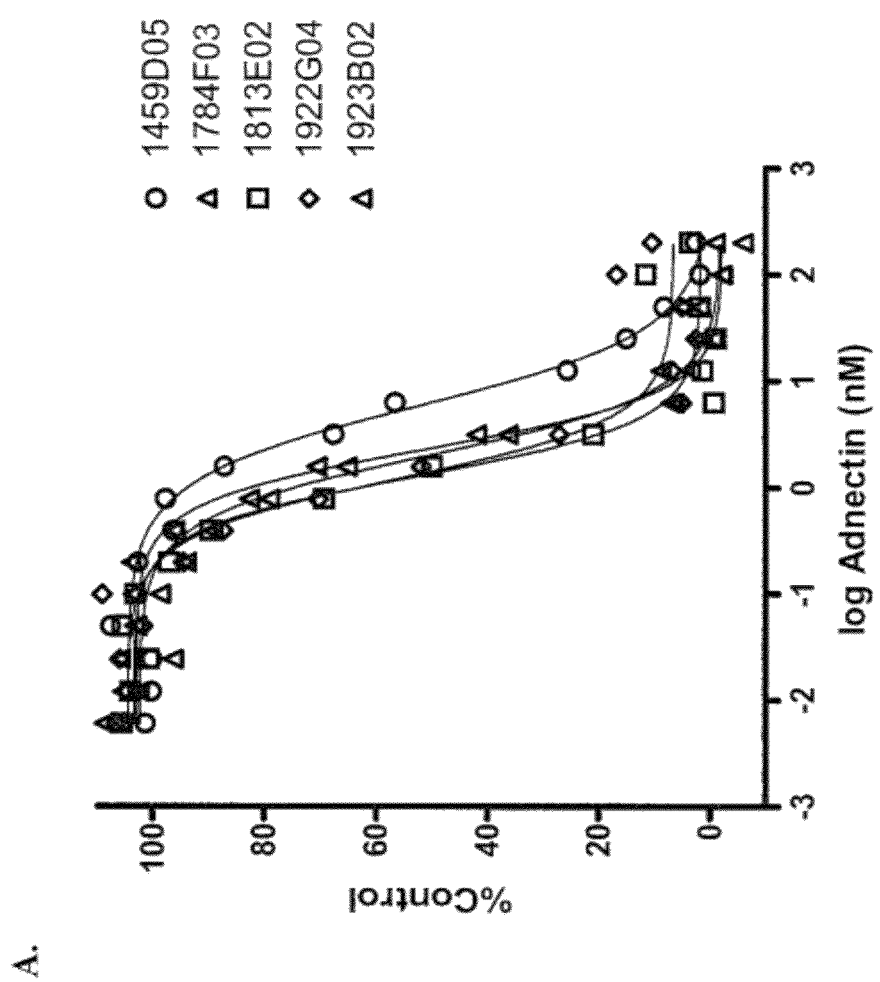
FIG. 3 shows the curve generated from a FRET assay which was used to measure the inhibition of human PCSK9: EGFA by PCSK9 Adnectin clones 1459D05, 1784F03, 1813E02, 1922G04 and 1923B02 (panel A) and clones 1459D05, 2012A04, 2011H05 and 2013E01 (panel B) as described in Example 2.
Figure 3:
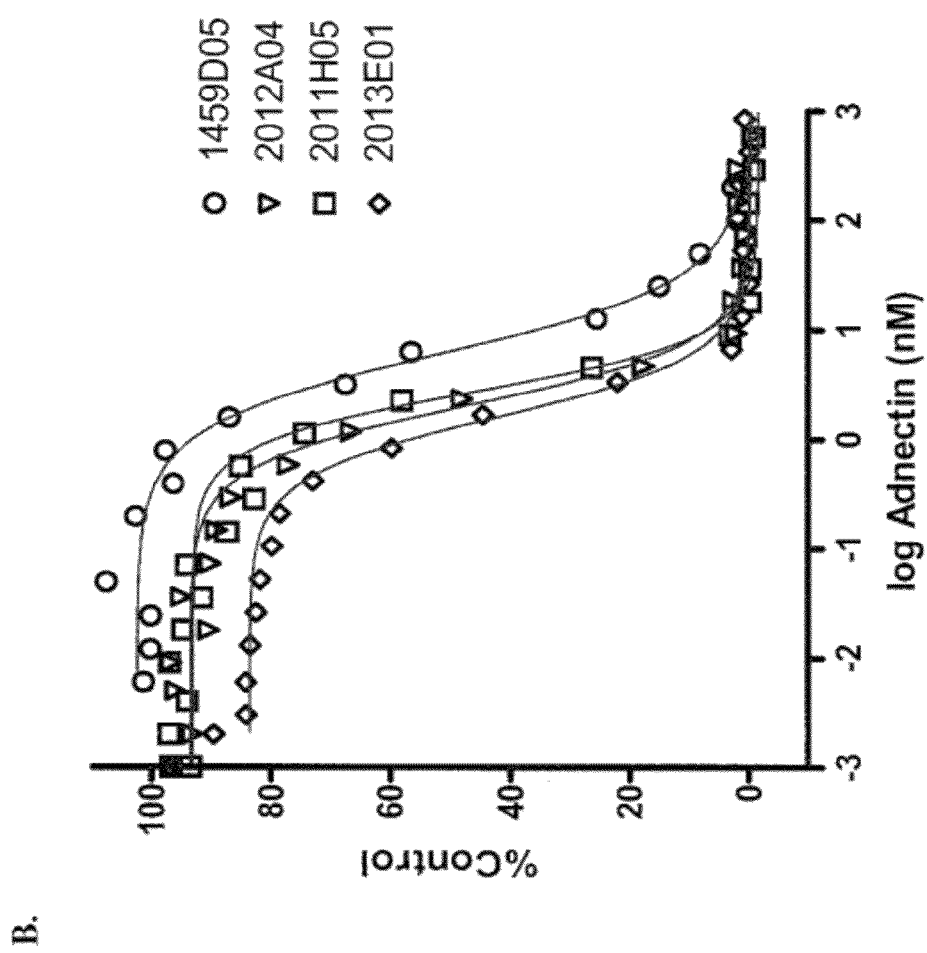

Three FRET based assays were developed to determine the binding affinity and potency of PCSK9-binding Adnectins, adapted from the general method described previously by Maio et al. (See, Miao, B. et al., *Meth. Enzymol.*, 357:180-188 (2002)). The PCSK9:EGFA FRET assay (FIGS. 2 and 3) measured the inhibition of PCSK9 binding to the low density lipoprotein receptor (LDLR) epidermal growth factor precursor homology domain (EGFA domain), using recombinant human PCSK9 expressed in baculovirus and a synthetic 40-mer EGFA peptide (biotinylated). EGFA has been shown to represent the key interacting domain of LDLR with PCSK9 (Kwon, H. J. et al., *Proc. Natl. Acad. Sci. USA*, 105(6):1820-1825 (2008)). This assay used a PCSK9 C-terminal domain binding mAb (mAb 4H5) labeled with Eu-chelate to provide FRET interaction with biotinylated EGFA through the streptavidin/allophycocyanin fluorophore complex.

Figure 4:
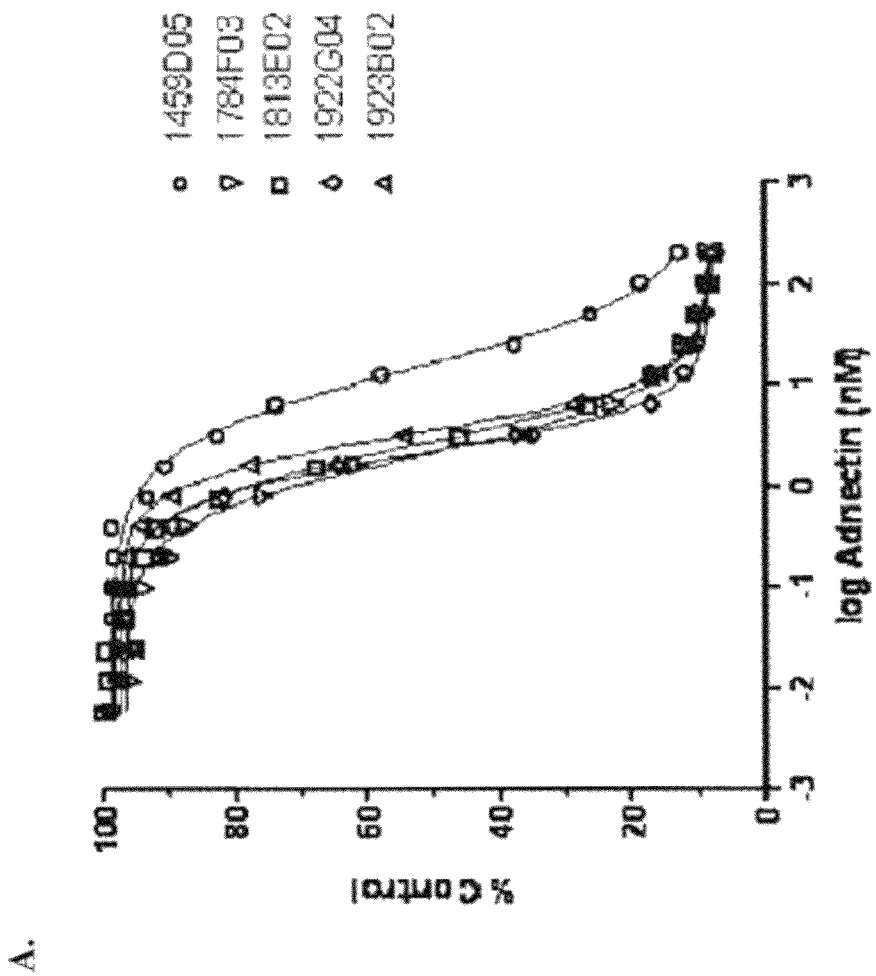
FIG. 4 shows the curve generated from a FRET assay which was used to measure the inhibition of human PCSK9: ATI000972 interaction by PCSK9 Adnectin clones 1459D05, 1784F03, 1813E02, 1922G04 and 1923B02 (panel A) and clones 2011H05, 2012A04 and 2013E01 (panel B) as described in Example 2.
Figure 4:
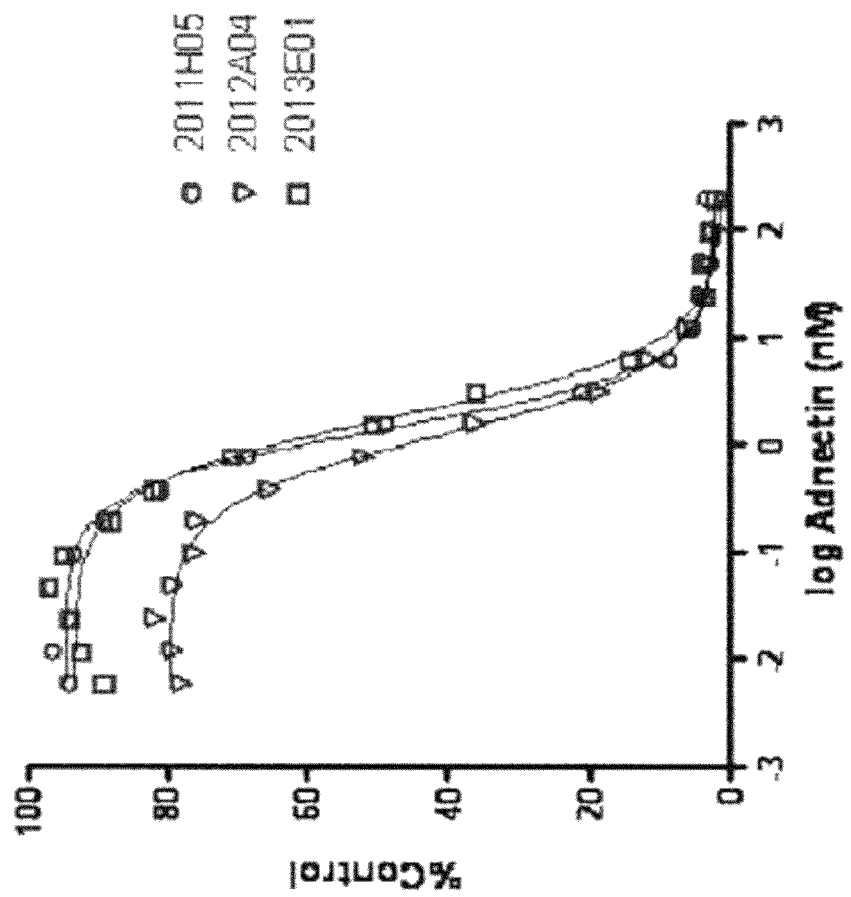
Figure 5:
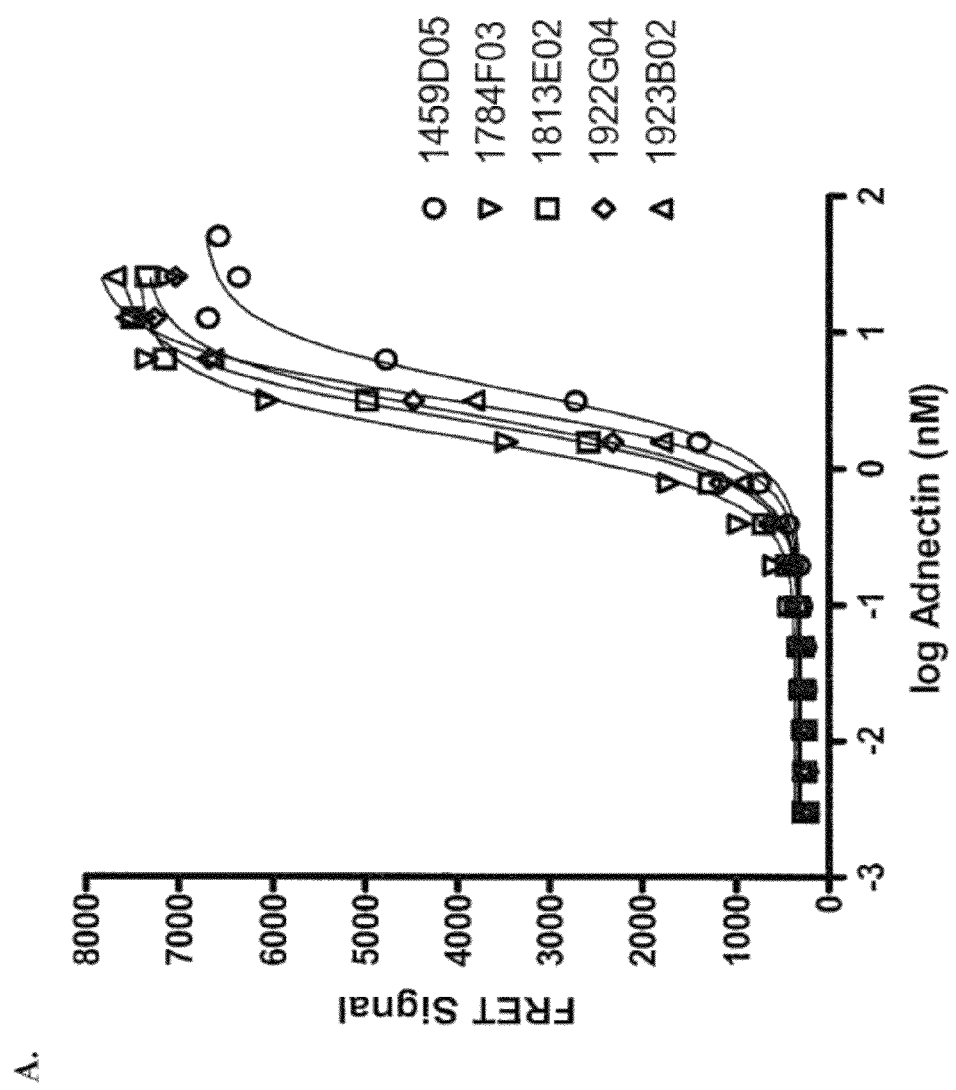
FIG. 5 shows the activity of the PCSK9 Adnectin clones 1459D05, 1784F03, 1813E02, 1922G04 and 1923B02 (panel A) and clones 2011H05, 2012A04 and 2013E01 (panel B) in the direct binding human PCSK9 FRET assay as described in Example 2.
Figure 5:
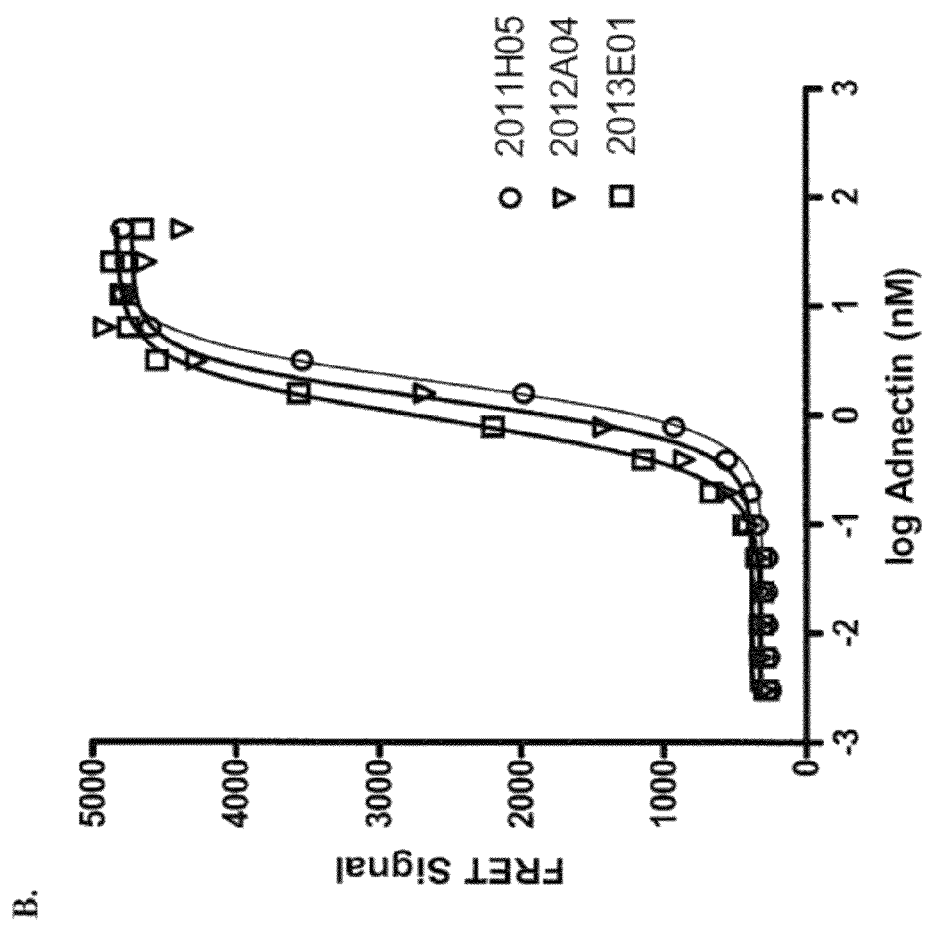

Two other related, PCSK9-dependent FRET assays were also constructed. In one of these assays, competitive displacement by Adnectins of biotinylated Adnectins-ATI000972 or ATI001125 is quantified (ATI000972 results shown in FIG. 4). ATI000972 is a biotinylated version of 1459D05 and ATI001125 is a biotinylated version of ATI001081. In another assay, direct binding of an Adnectin (his-tagged) to PCSK9 is assayed using anti-his6 antibody (FIG. 5). In each of the FRET assays, human PCSK9 concentration was either 1 or 5 nM. In some cases cynomolgus monkey PCSK9 replaced hPCSK9. Table 11 summarizes the overall data from these three FRET assays.

TABLE 11

Summary of Adnectin Testing Data for 3 FRET Assays Using Human PCSK9 and 1 Assay for Cyno PCSK9

| Clone ID | hPCSK9:EGFA IC50 (nM) | hPCSK9:ATI000972 IC50 (nM) | hPCSK9:ATI001125 IC50 (nM) | Direct binding hPCSK9 EC50 (nM) | cPCSK9:EGFA IC50 (nM) |
|---|---|---|---|---|---|
| 1459D05 | 4.0 | 14 | nd | 3.9 | 2300 |
| 1784F03 | 2 | 1.9 | nd | 1.6 | 106 |
| 1813E02 | 1.3 | 2.4 | nd | 2.3 | 118 |
| 1923B02 | 2.3 | 3.2 | nd | 3.2 | 53.5 |
| 1922G04 | 1.2 | 2.0 | nd | 2.5 | 26.6 |
| 2012A04 | 2.1 | 1.2 | nd | 1.4 | 70.3 |
| 2011H05 | 2.7 | 1.4 | nd | 2.0 | 17.2 |
| 2013E01 | 1.6 | 1.8 | nd | 0.90 | 12.5 |
| 1922G04 (R25D) | 2.5 | nd | nd | nd | 48.1 |
| 1922G04 (R25E) | 3.5 | nd | nd | nd | 58.5 |
| 2382E03 | 2.4 | nd | 0.5 | 3.7 | 10.8 |
| 2382E05 | 2.8 | nd | 0.4 | 3.8 | 12.6 |
| 2381B08 | 2.6 | nd | 1 | 4.1 | 27.1 |
| 2381B02 | 2.5 | nd | 0.5 | 8.4 | 9.8 |
| 2381B04 | 2.4 | nd | 0.5 | 4.2 | 17.3 |
| 2451H07 | 0.2 | nd | 0.2 | 13.2 | 27.1 |
| 2381D04 | 2.9 | nd | 0.5 | 3.7 | 12 |
| 2381F11 | 4 | nd | 0.8 | <1 | 26.5 |
| 2381G09 | 3.1 | nd | 1.1 | 4.5 | 25.2 |
| 2381H09 | 3.4 | nd | 0.5 | 4.1 | 20.2 |
| 2382B09 | 3.8 | nd | 0.6 | 4.0 | 37.2 |
| 2382B10 | 3 | nd | 0.5 | 3.1 | 18.1 |
| 2382C05 | 4 | nd | 0.9 | 3.4 | 27.2 |
| 2382C09 | 3.5 | nd | 0.6 | 2.9 | 23.9 |
| 2382D03 | 3.3 | nd | 0.6 | 3.3 | 11.8 |
| 2382D09 | 2.6 | nd | 0.4 | 3.7 | 13.9 |
| 2382F05 | 2.4 | nd | 0.9 | 3.8 | 14.6 |
| 2382G04 | 2.9 | nd | 0.5 | 3.6 | 20.1 |
| 2382H03 | 3.4 | nd | 0.3 | 3.8 | 19.8 |
| 2382H09 | 0.9 | nd | 0.3 | 3.6 | 17.9 |
| 2382H10 | 2.6 | nd | 0.4 | 4.6 | 18.2 |
| 2382D02 | 4.5 | nd | 0.5 | 5.3 | 57.8 |
| 2451C06 | 1.2 | nd | 0.4 | 5.5 | 24.7 |

Cell-Based Inhibition of PCSK9 Activity by PCSK9 Adnectins

DiI-LDL Uptake Assay

Figure 6:
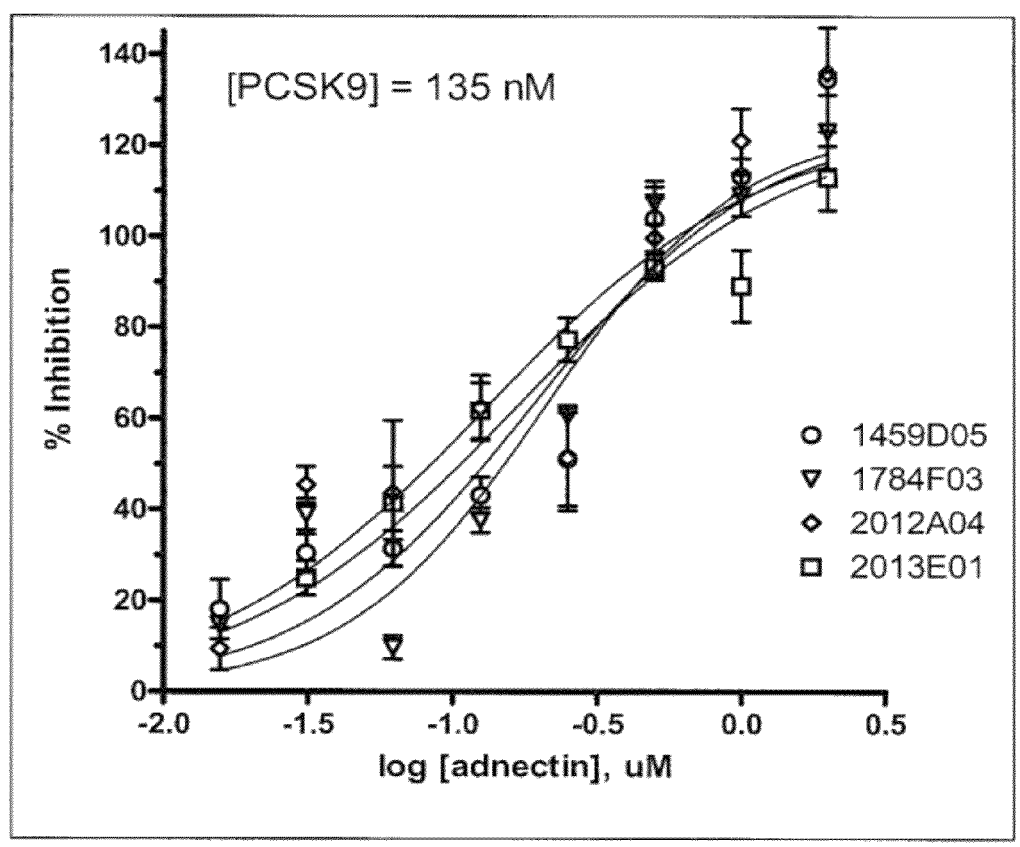
FIG. 6 shows the inhibition of PCSK9 activity in HepG2 cells assayed by the DiI-LDL uptake method as described in Example 2.

Cell culture methods were developed to assay the ability of Adnectins to inhibit PCSK9 activity on the LDLR. An effective means of measuring cellular LDLR activity is through an assay for uptake of labeled LDL, as shown by Lagace, T. A. et al. (*J. Clin. Invest.*, 116(11):2995-3005 (2006)). The work further adapted a method for LDLR functional activity using fluorescent-labeled LDL (DiI-LDL) uptake adapted from a method originally shown by Teupser et al. (*Biochim. Biophys. Acta*, 1303(3):193-198 (1996)). Cells were first preincubated with recombinant human PCSK9 protein (10 ug/mL, 135 nM) in the presence and absence of Adnectins as shown. After 2 hours, the remaining LDLR activity was assayed by incubation with DiI-LDL (5 ug) for 2 hours followed by an assessment of accumulated DiI-LDL inside the cells using high content fluorescent micrscopy and image analysis (Cellomics). FIG. 6 shows the effect of several Adnectins to inhibit PCSK9 activity and restore LDLR functional activity in HepG2 cells. In this assay, the Adnectins inhibited PCSK9 and restored DiI-LDL uptake with the following $EC_{50}$ values: 1459D05, $EC_{50}$=190 nM; 1784F03, 210 nM; 2012A04, 130 nM; 2013E01, 160 nM.

LDLR Depletion Assay

HepG2 cells were grown in complete media, Eagle's Minimum Essential Medium (EMEM, ATCC®) with 10% FBS (Hyclone), and split twice a week with Trypsin 0.25% (Invitrogen). To induce upregulation of the LDL receptor, cells were incubated overnight in LPDS media [RPMI (ATCC) with 5% lipoprotein deficient serum (Intracel), 100 nM superstation (BMS) and 50 uM Sodium Mevalonate (Sigma)]. The following day, cells were trypsinized briefly with Trypsin 0.05% (Invitrogen) and resuspended at 2×10^6 cells per ml then aliquoted at 100 ul per well in a V-bottom 96 well plate. In the meantime, Adnectins were pre-incubated with PCSK9 in LPDS media for an hour at 37° C. After an hour, cells were centrifuged and resuspended in 100 ul of Adnectin/PCSK9 mix and incubated overnight at 37° C. The following day cells were labeled with an antibody for LDL receptor (BAF 2148 from R&D), followed by a phycoerythrin (PE)-streptavidin conjugated secondary antibody (BD554061 from BD Pharmingen) and analyzed by FACS on the FACS Cantoll (BD).

Figure 7:
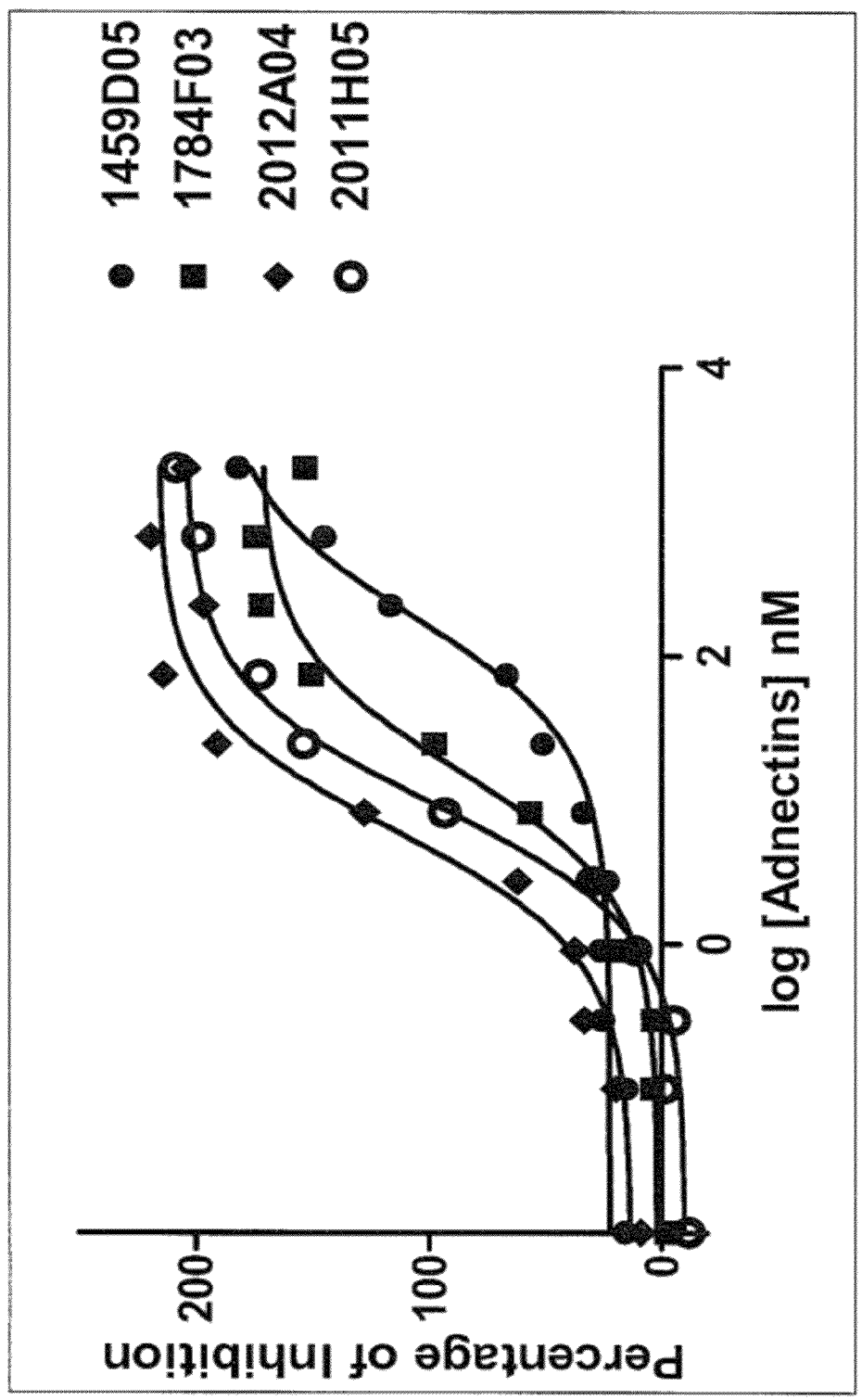
FIG. 7 shows the inhibition of PCSK9-induced LDLR depletion from HepG2 cell surface by PCSK9 Adnectin clones 1459D05, 1784F03, 2012A04, and 2011H05 (panel A) and Clone ID 2011H05, 2012A04 and 2013E01 (panel B) as described in Example 2. The EC$_{50}$ (nM) of 1784F03, 2012A04, 2011H05, and 2013E01 are 15.98, 7.78, 8.85, and 12.41, respectively; the percentage of PCSK9 inhibition at 75 nM of PCSK9 Adnectin clones 1459D05, 1784F03, 2012A04, 2011H05, and 2013E01 are 66.8, 150.2, 190.1, 177.4, and 152.2, respectively.
Figure 7:
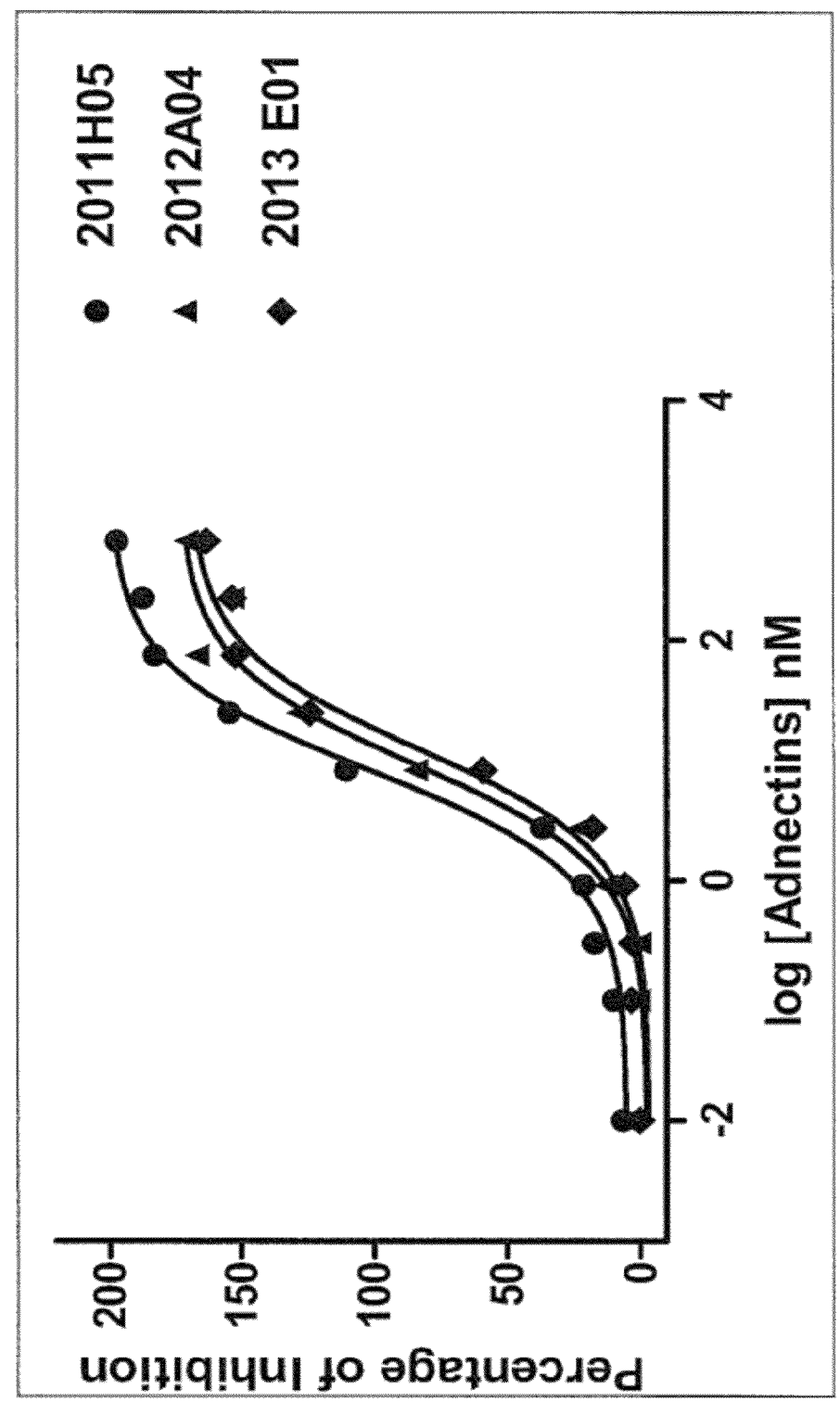

10 nM of PCSK9 was pre-incubated for an hour with increasing concentration of Adnectin candidates before being added to HepG2 cells. After overnight incubation LDLR level were measured by FACS and the percentage of inhibition of PCSK9-induced LDLR depletion was graphed and EC50 determined using PRISM. 1459D05 appears to be the least potent candidate among those tested and did not reach the maximum inhibition whereas the other clones reach 150-200% maximum inhibition of PCSK9 (FIG. 7). A summary of the PCSK9 Adnectin in vitro pharmacology data is shown below in Table 12.

TABLE 12

| Clone ID | % monomer (SEC-HPLC) | Tm (° C., DSC) | KD hPCSK9 (37° C., Octet Red) (nM) | $K_D$ hPCSK9 (25° C., ProteOn) (nM) | Cyno cross-reactivity $K_D$ cPCSK9 (25° C., ProteOn) (nM) | Cyno PCSK9: EGFA FRET ($EC_{50}$, nM) | PCSK9: GFA FRET ($EC_{50}$, nM) | LDLR Depletion % inhibition at 75 nM | LDLR Depletion $EC_{50}$ (nM) |
|---|---|---|---|---|---|---|---|---|---|
| 1459D05 | ≧95 | 63 | 14.4 | 1.58 | >1000 | >1000 | 5.8 | 66.8 | >200 |
| 1813E02 | ≧95 | 70 | nd | nd | nd | 118.5 | 2.7 | nd | 16 |
| 1784F03 | ≧95 | 65 | nd | nd | nd | 106.5 | 2.01 | 150.2 | 26 ± 13 |
| 1923B02 | ≧95 | 73 | nd | 0.17 | nd | 53.5 | 2.3 | 178 | 23 ± 7 |
| 1922G04 | 100 | 83 | nd | 0.09 | 15.0 | 26.6 | 1.2 | 105.1 | 10 ± 2 |
| 2013E01 | 100 | 81 | nd | 0.29 | 8.1 | 12.5 | 1.6 | 165.5 | 10 ± 4 |
| 2012A04 | 100 | 84 | nd | 0.25 | 24.3 | 70.3 | 2.1 | 144.5 | 12 ± 6 |
| 2011H05 | 100 | 76 | nd | 0.08 | 23.1 | 17.2 | 2.7 | 197.6 | 12 ± 5 |
| 2382D05 | 97 | 86 | 0.314 | nd | nd | 57.8 | 2.6 | 140.5 | nd |
| 2382E03 | 96 | 83 | 2.94 | nd | nd | 10.8 | 2.4 | 89.5 | nd |
| 2382E05 | 95 | 84 | 0.604 | nd | nd | 12.6 | 2.8 | 103.5 | nd |
| 2381B02 | 96 | 68 | 3.29 | nd | nd | 9.8 | 2.5 | 125.4 | nd |
| 2381B04 | 98 | 77 | 0.527 | nd | nd | 17.3 | 2.4 | 121.6 | nd |
| 2381B08 | 97 | 78 | 4.11 | nd | nd | 27.1 | 2.6 | 124.8 | nd |
| 2381D04 | 98 | 70 | 0.237 | nd | nd | 12 | 2.9 | 119.2 | nd |
| 2381F11 | 95 | 79 | 1.59 | nd | nd | 26.5 | 4 | 110.2 | nd |
| 2381G09 | 96 | 78 | 1.12 | nd | nd | 25.2 | 3.1 | 133.0 | nd |
| 2381H09 | 77 | 63 | 3.23 | nd | nd | 20.2 | 3.4 | 94.4 | nd |
| 2382B09 | 99 | 88 | 0.656 | nd | nd | 37.2 | 3.8 | 105.0 | nd |
| 2382B10 | 99 | 82 | 2.35 | nd | nd | 18.1 | 3 | 100.2 | nd |
| 2382C05 | 97 | 85 | 2.49 | nd | nd | 27.2 | 4 | 105.3 | nd |
| 2382C09 | 96 | 85 | 0.757 | nd | nd | 23.9 | 3.5 | 121.7 | nd |
| 2382D03 | 97 | 84 | 1.53 | nd | nd | 11.8 | 3.3 | 80.4 | nd |
| 2382D09 | 93 | 84 | 0.304 | nd | nd | 13.9 | 2.6 | 109.1 | nd |
| 2382F05 | 99 | 83 | 4.54 | nd | nd | 14.6 | 2.4 | 72.2 | nd |
| 2382G04 | 95 | 81 | 1.11 | nd | nd | 20.1 | 2.9 | 146.1 | nd |
| 2382H03 | 96 | 85 | 0.677 | nd | nd | 19.8 | 3.4 | 102.1 | nd |
| 2382H09 | 95 | 81 | 1.86 | nd | nd | 17.9 | 0.9 | 101.2 | nd |
| 2382H10 | 97 | 87 | 1.40 | nd | nd | 18.2 | 2.6 | 118.6 | nd |
| 2451B06 | nd | nd | nd | nd | nd | 57.8 | 4.5 | 92.2 | nd |
| 2451C06 | 96 | 87 | 1.27 | nd | nd | 24.7 | 1.2 | 89.4 | nd |
| 2451H07 | 97 | 87 | 2.08 | nd | nd | 27.1 | 0.2 | 88.8 | nd |

Example 3

In Vivo Pharmacodynamic Effects of PCSK9 Adnectins Human PCSK9 Transgenic Mouse Models PCSK9 Adnectins exhibited pharmacodynamic effects in vivo in two different human transgenic mouse models. One mouse model overexpresses human PCSK9 levels markedly and exhibits hypercholesterolemia as a result (Lagace, T. A. et al., J. Clin. Invest., 116(11):2995-3005 (2006)). The other mouse model is a genomic hPCSK9 transgenic (BAC-transgenic) which is regulated in liver similarly to mouse PCSK9 and which expresses near human-normal levels of hPCSK9 in plasma. For these studies, ELISA assays using species-specific, site-specific labeled antibodies and Adnectins were developed to measure plasma unbound human PCSK9 levels (i.e., hPCSK9 not complexed with the administered Adnectin) as an index of target engagement.

Figure 8:
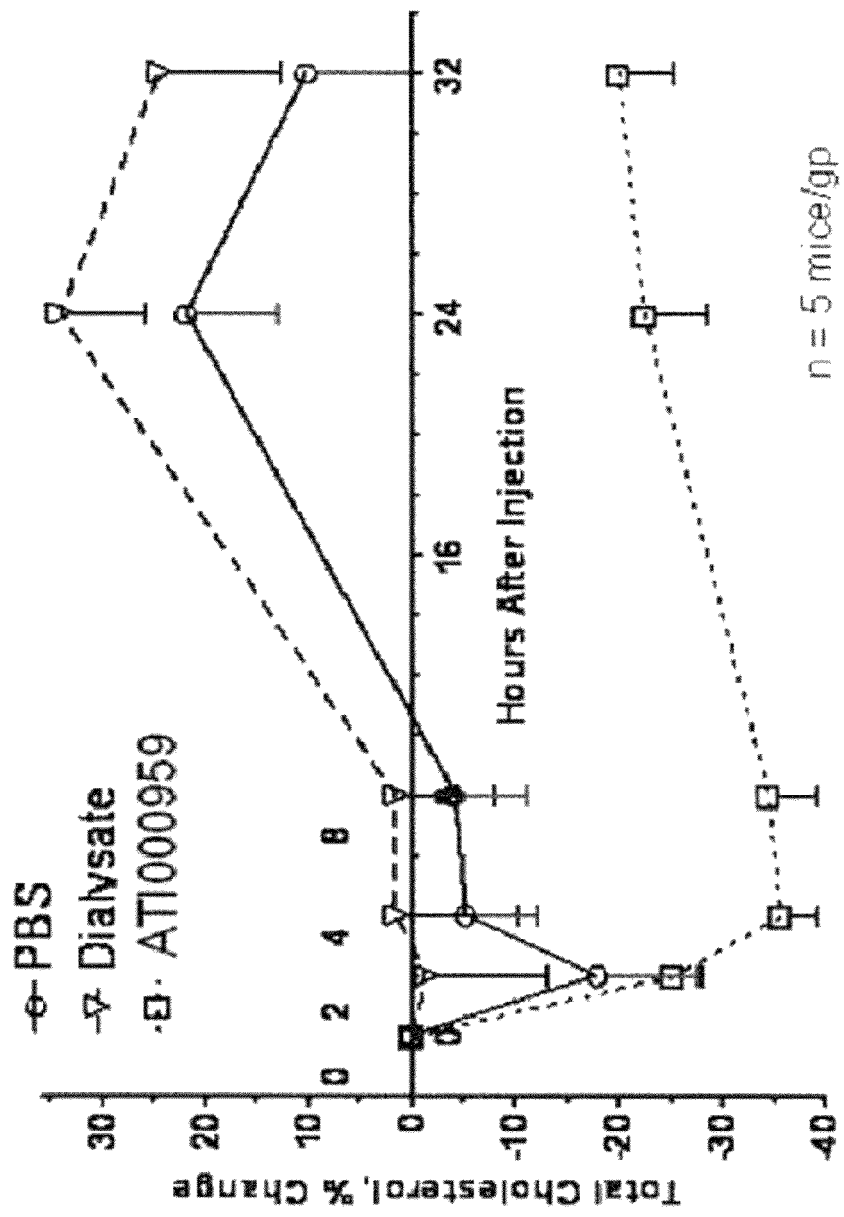
FIG. 8 shows the in vivo effect of PCSK9 Adnectin ATI000959 (100 mg/kg) on plasma cholesterol (panel A) and plasma unbound hPCSK9 (panel B) in hPCSK9 overexpressing transgenic mice as described in Example 3. ATI000959 contains a 40 kDa branched NOF PEG.
Figure 8:
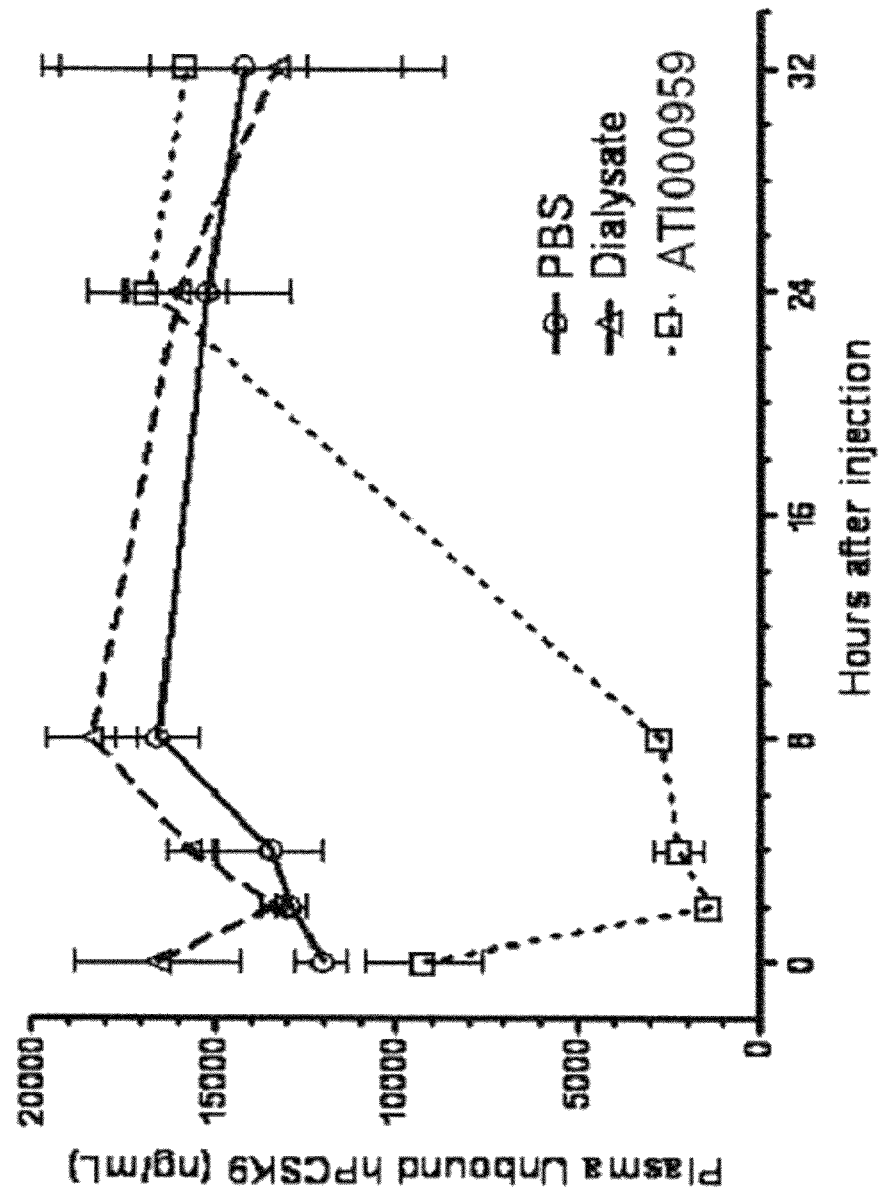
Figure 9:
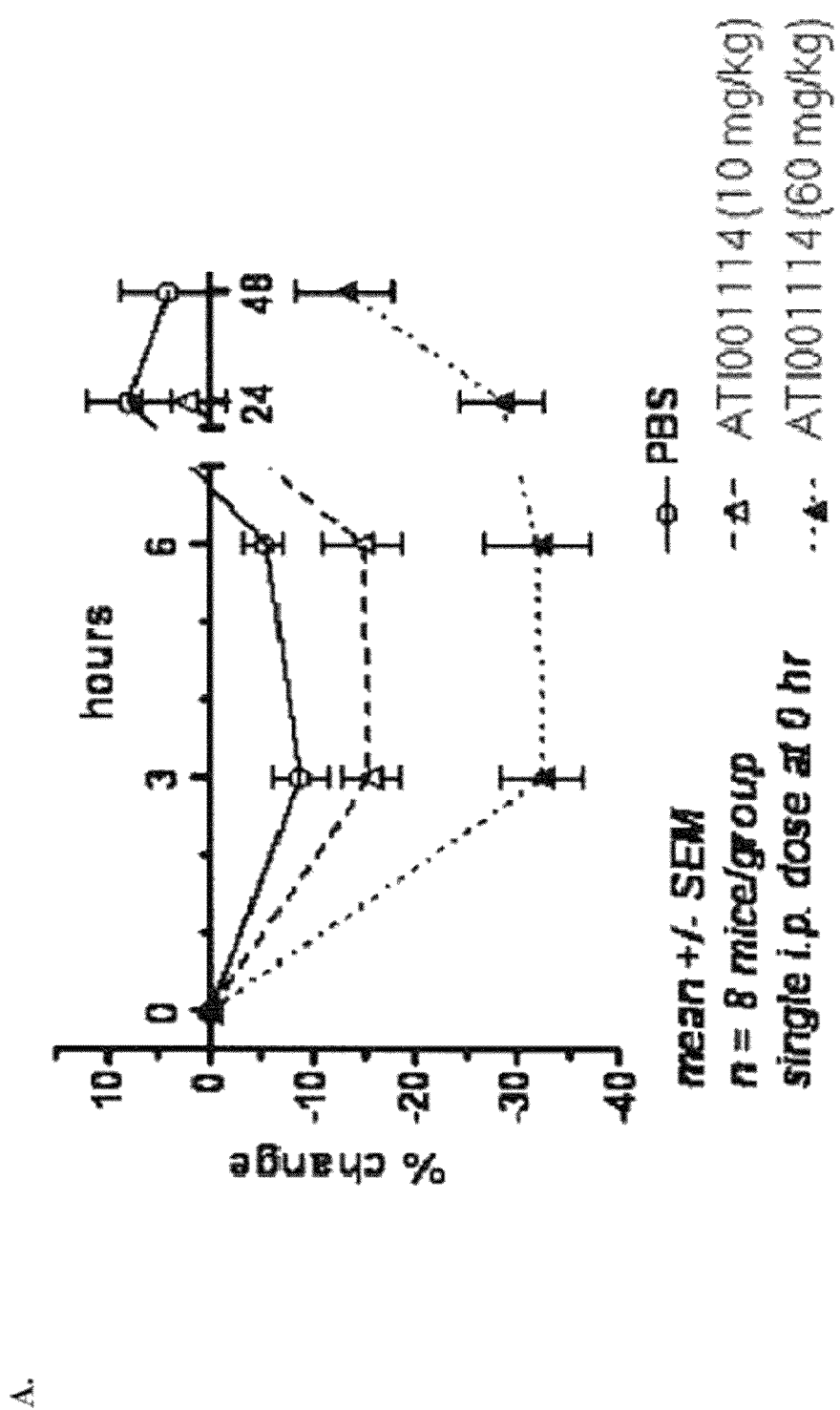
FIG. 9 shows the in vivo effect of the PCSK9 Adnectin ATI001114 (10 or 60 mg/kg) on plasma cholesterol levels (panel A) and on plasma unbound hPCSK9 levels (panel B) in hPCSK9 overexpressing transgenic mice as described in Example 3.
Figure 9:
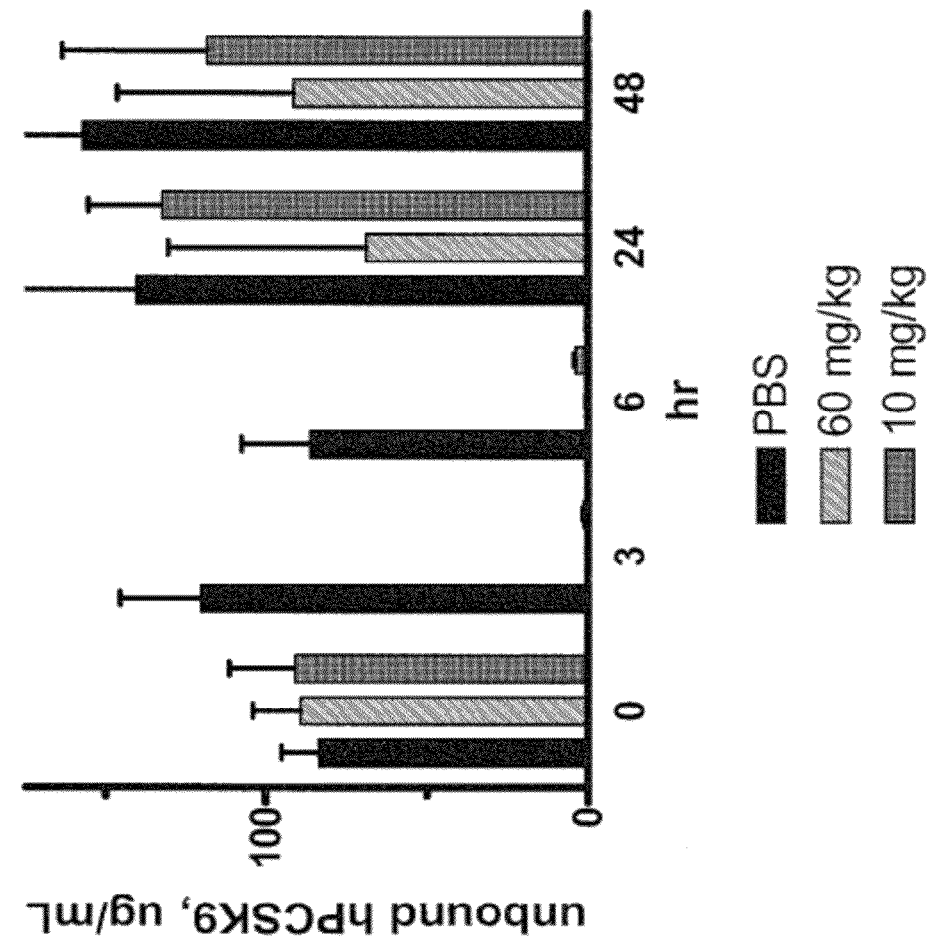

Single doses of PCSK9 Adnectins in PEGylated form were injected intraperitoneally into the overexpresser hPCSK9 transgenic mouse model at the doses shown in FIGS. 8-9. PBS or dialysate samples were also injected as controls. Adnectin 1459D05-PEG (100 mg/kg intraperitoneal) treatment rapidly decreased plasma total cholesterol (FIG. 8A) and LDL-C (not shown) to >35% below baseline in 4 hr. Cholesterol levels in Adnectin treated mice remained below control levels throughout the 48 hr test period. This was accompanied by a sharp decrease in circulating levels of unbound hPCSK9 in the Adnectin treated transgenic mice (FIG. 8B). Western blots of liver taken at 6 hours in parallel studies showed that LDLR protein levels were increased ~2-fold in Adnectin-treated mice (not shown). In further studies in this transgenic mouse model, ATI001114 was administered at 10 or 60 mg/kg. A marked, dose-dependent, rapid lowering of plasma cholesterol was seen, concomitant with a dose-related reduction in unbound hPCSK9 levels (FIG. 9). These studies represent in vivo proof-of-concept for PCSK9 Adnectins as effective cholesterol lowering agents in a hypercholesterolemic human transgenic PCSK9 mouse model.

Figure 10:
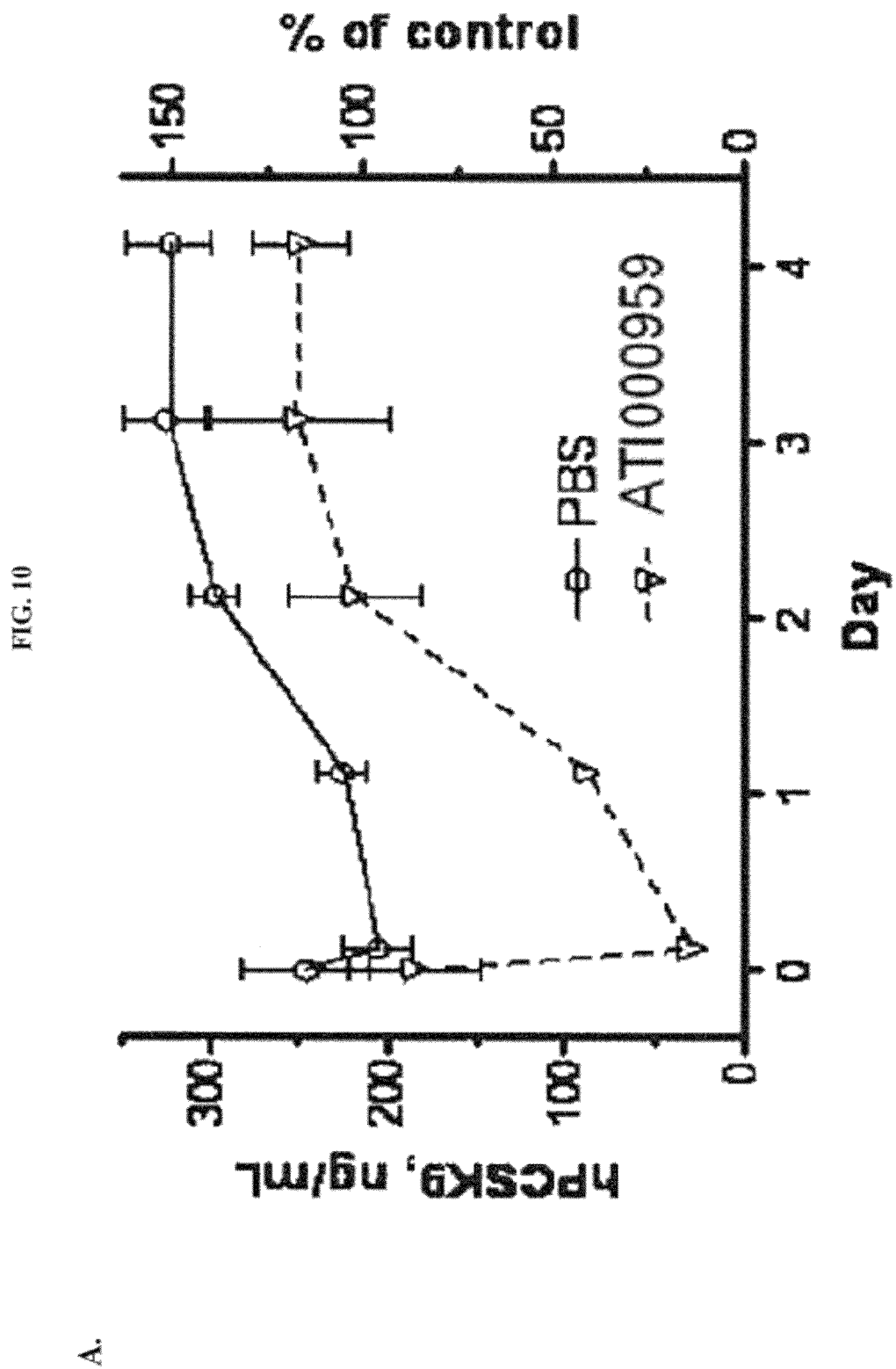
FIG. 10 shows the in vivo effect of the PCSK9 Adnectins ATI000959 (panel A) or ATI001114 (panel B) administered at 5 mg/kg intraperitoneal (i.p.), single dose, on unbound plasma hPCSK9 in normal expresser hPCSK9 transgenic mice (mean+/−SD) as described in Example 3.
Figure 10:
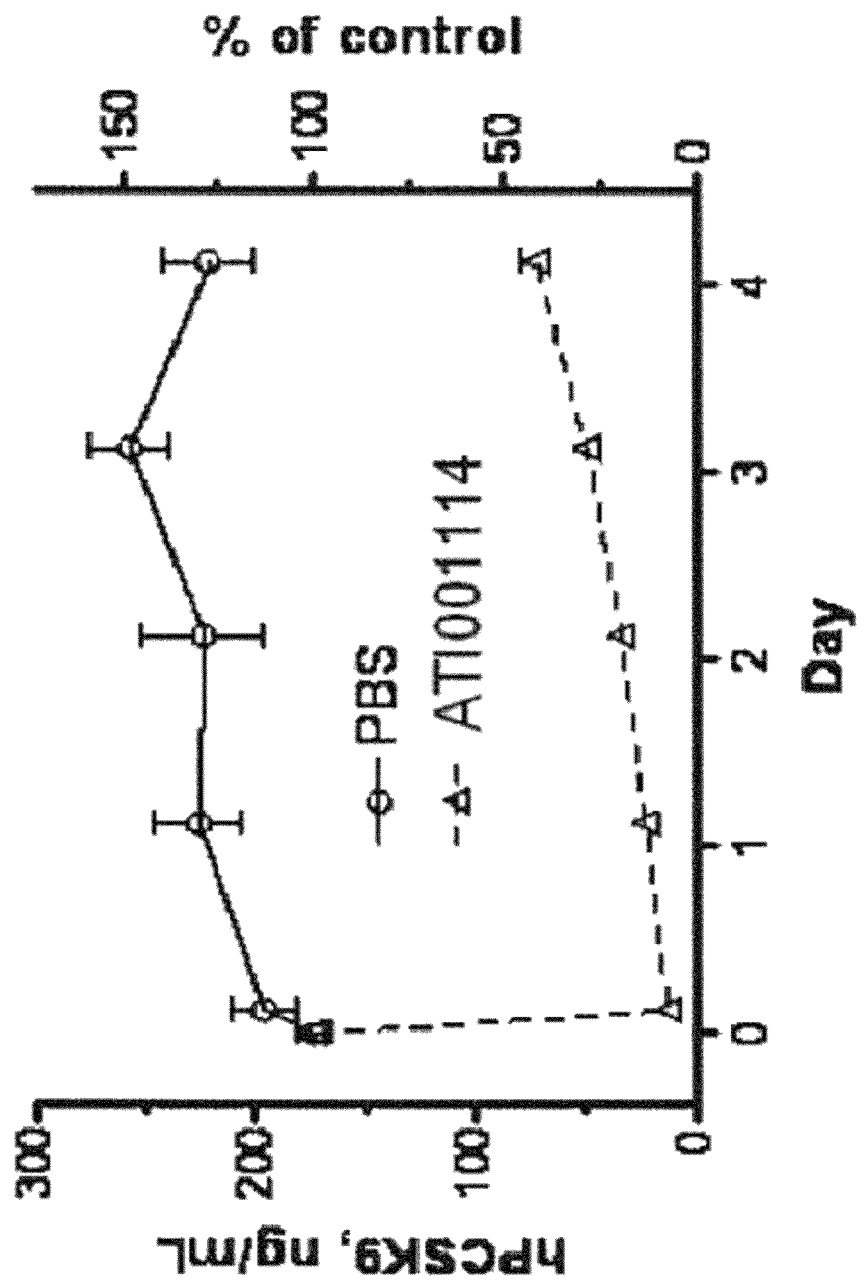
Figure 11:
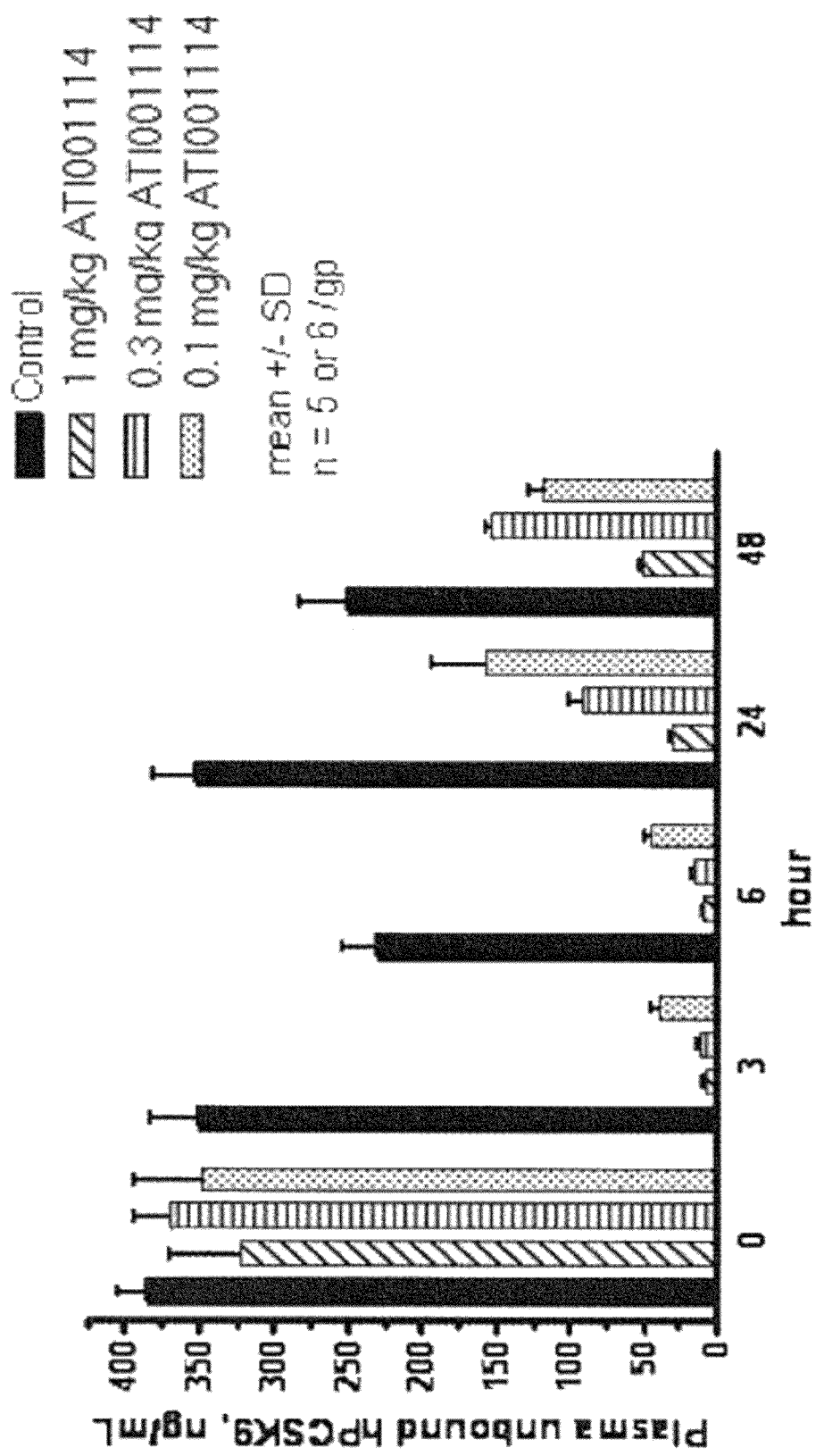
FIG. 11 shows the dose-dependent effect of the PCSK9 Adnectin ATI001114 on unbound hPCSK9 in normal expresser hPCSK9 transgenic mice as described in Example 3.

In vivo studies were conducted in the normal expresser hPCSK9 transgenic mouse model. Injection of single doses of 1459D05-PEG or ATI001114 (5 mg/kg) resulted in rapid and strong decreases in unbound hPCSK9 levels in plasma (FIG. 10). This pharmacodynamic effect on unbound hPCSK9 was more pronounced following ATi001114 compared to 1459D05-PEG, with greater magnitude and duration of effect observed for the higher affinity/potency Adnectin. A further study of dose dependency revealed that that the 50% inhibitory dose (ED50) was less than 0.1 mg/kg for ATI001114 at time points from 3 to 48 hours post-dose, as seen in FIG. 11. These findings in a normal expresser transgenic mouse model show that PCSK9 inhibitory Adnectins exhibit marked, affinity-dependent and dose-dependent effects on pharmacodynamic endpoints which are correlated with LDLR regulation and LDL cholesterol lowering.

Cynomolgus Monkeys

Figure 12:
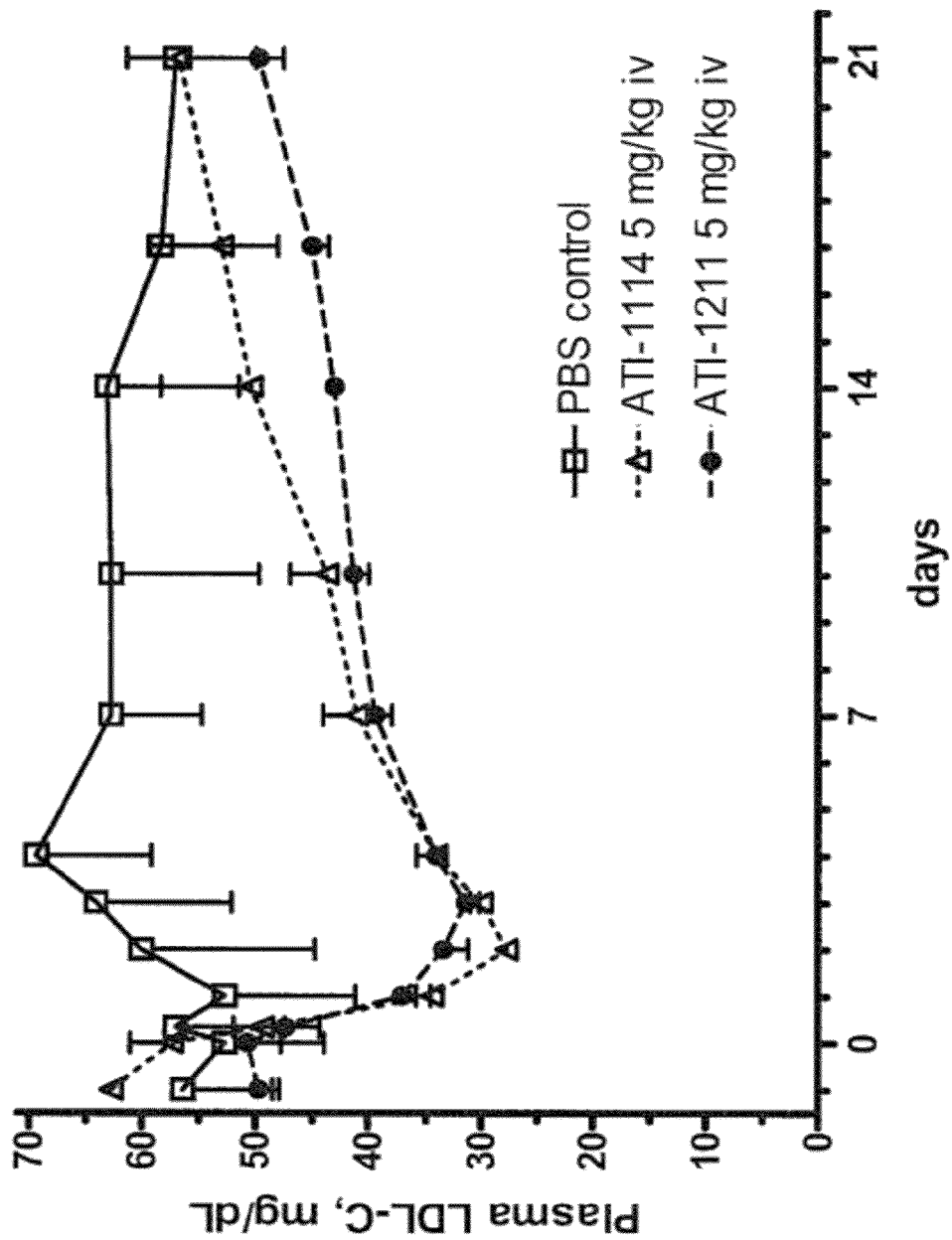
FIG. 12 shows the effect of single dose of the PCSK9 Adnectin ATI001114 (5 mg/kg i.v.) on LDL-C lowering in cynomolgus monkeys (mean+/−SEM, n=3) as described in Example 3.

A pharmacodynamic study was conducted in normal lean cynomolgus monkeys. Adnectin ATI001114 was administered to cynos intravenously at 5 mg/kg, and plasma samples were collected at time intervals for LDL-C assay and pharmacokinetic assessment. A single dose of ATI001114 rapidly lowered plasma LDL-C levels to >50% vs. baseline (or vs. PBS control group) within 48 hours (FIG. 12). The duration of effect on LDL-C continued for more than a week with eventual return to baseline by 3 wk. This effect was observed with both two-branched and four-branched 40 kDa PEGylated forms of the anti-PCSK9 Adnectin (ATI001114 and ATI001211, respectively). ATI001211 is ATI001081 with a 40 kDa 4-branched NOF PEG moiety. Total cholesterol showed a similar pattern but no effect on HDL or other metabolic parameter was observed (not shown). Pharmacokinetic analysis revealed that the plasma half-life was approximately 80-120 hrs, consistent with the pharmacodynamics of LDL lowering in the cynos. These findings indicate that a PCSK9 Adnectin is efficacious and fast-acting with rapid, robust, specific effects on LDL-C lowering in cynomolgus monkey model.

Example 4

In Vitro and In Vivo Pharmacological Evaluation of the PCSK9 Adnectin-Fc Fusion Protein, PRD460

Production of PRD460

A vector encoding PRD460 was transfected into HEK-293 6E cells using polyethylenimine (PEI). The cells were grown at 37° C. for 5 days with 80% humidification and 5% $CO_2$. The cells were then pelleted, the supernatant was passed through a 0.22 um filter and then loaded onto to a ProteinA column. The column was washed with PBS and the protein was eluted with 20 mM Gylcine, 150 mM NaCl pH 2.8. The eluted protein was concentrated and passed over a superdex200 column in 50 mM MES, 100 mM NaCl pH 5.8.

PRD460 $K_D$ by SPR

The binding characteristics were characterized by Surface Plasmon Resonance (SPR). Anti-human antibody was immobilized on a BIACORE® chip, and PRD460 (sequence as set forth in SEQ ID NO: 322) was captured on the chip surface. Varying concentrations of hPCSK9 were placed into the flow solution using $MgCl_2$ (3 M) for chip regeneration between cycles. For comparison, ATI-1081 was captured on an anti-His antibody immobilized on a BIACORE® chip. Duplicate experiments for PRD460 were performed on different days. Kinetic determinations were performed at 25° C. Evaluation of the kinetic parameters was performed using the 1:1 Binding algorithm on the BIACORE® Evaluation software.

Under these conditions, ATI-1081 bound to human PCSK9 with a dissociation constant ($K_D$) of 6.7 nM at 25° C. and PRD460 bound to human PCSK9 with a dissociation constant ($K_D$) of 3.29+/−0.55 nM at 25° C. (Table 13). The off-rate determinations using this assay format may be artificially limited by the off-rate of the captured ligand from the immobilized capture antibody, thus the assay format using direct immobilization of PCSK9 is a more accurate reflection of dissociation constant ($K_D$) for ATI-1081.

TABLE 13

Kinetic Parameters for PRD460 and ATI-1081 Against Captured Human PCSK9

| | ka (1/Ms) | kd (1/s) | KD (nM) |
| --- | --- | --- | --- |
| PRD460 | 3.75 +/− 0.7E+04 | 1.21 +/− 0.05E−04 | 3.29 +/− 0.55 |
| ATI-1081 | 3.65E+04 | 2.45E−04 | 6.7 |

PCSK9 Binding FRET Assays

Two fluorescence resonance energy transfer (FRET) based assays were used to determine the competitive binding potency of PRD460 and other Adnectins to hPCSK9. The PCSK9:EGFA FRET assay measures the binding of PCSK9 to the LDLR, using a soluble epidermal growth factor precursor homology domain-A (EGFA) peptide and recombinant human PCSK9. The PCSK9:ATI972 FRET assay measures competitive displacement by Adnectins of the biotinylated Adnectin, ATI-972, from PCSK9.

In the PCSK9:EGFA FRET assay (at 5 nM PCSK9), PRD460 completely and potently displaced EGFA from the PCSK9 binding site with EC50=0.7 nM (FIG. 1, left panel). PRD460 was more potent in this assay than either ATI-1174 (EC50=1.9 nM) or ATI-1081 (EC50=3.7 nM) (FIG. 14). The greater apparent potency of PRD460 in this assay may be explained by bivalent (2:1) binding of Adnectin PRD460 to PCSK9 (theoretically) compared to monovalent (1:1) binding by ATI-1081 and ATI-1174.

Figure 15:
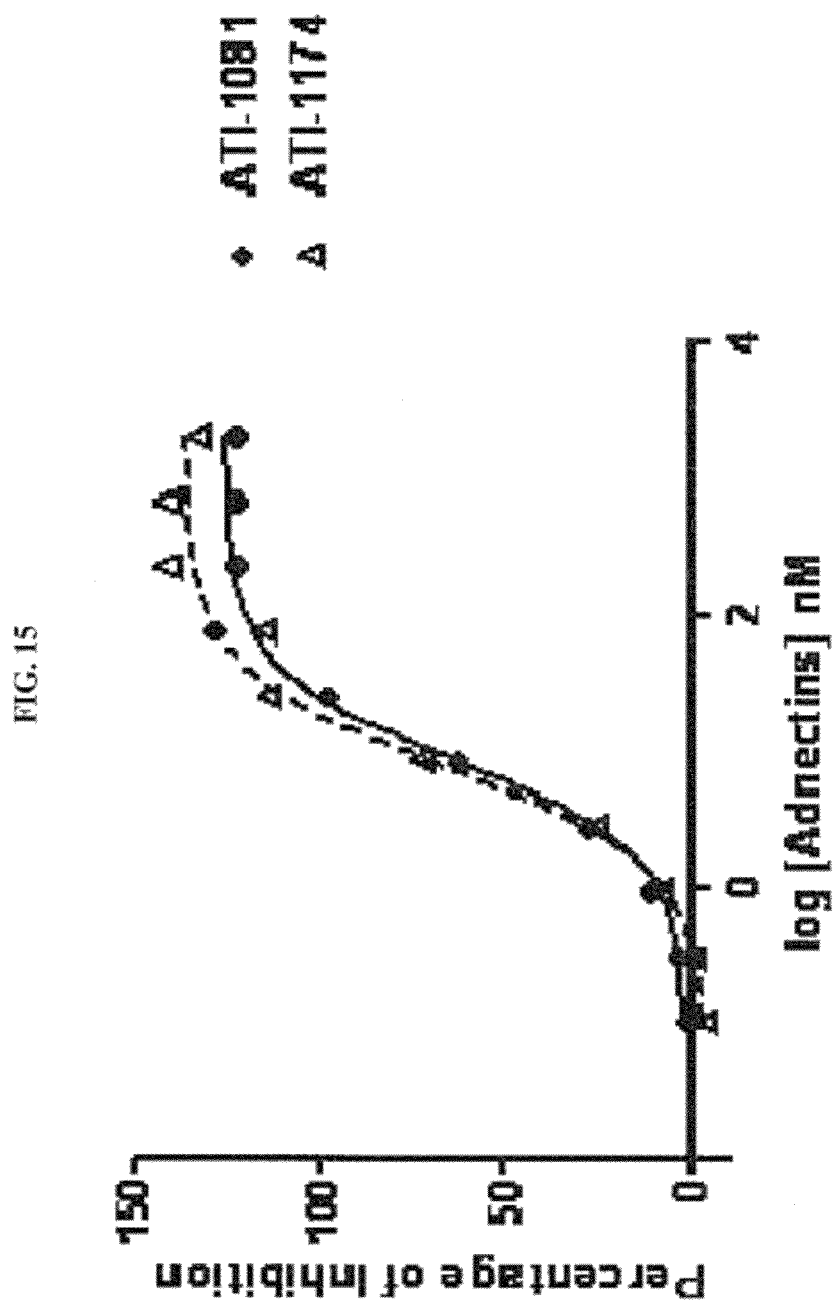
FIG. 15. Inhibition of PCSK9-induced LDLR depletion from HepG2 cell surface by anti-PCSK9 Adnectins.
Figure 15:
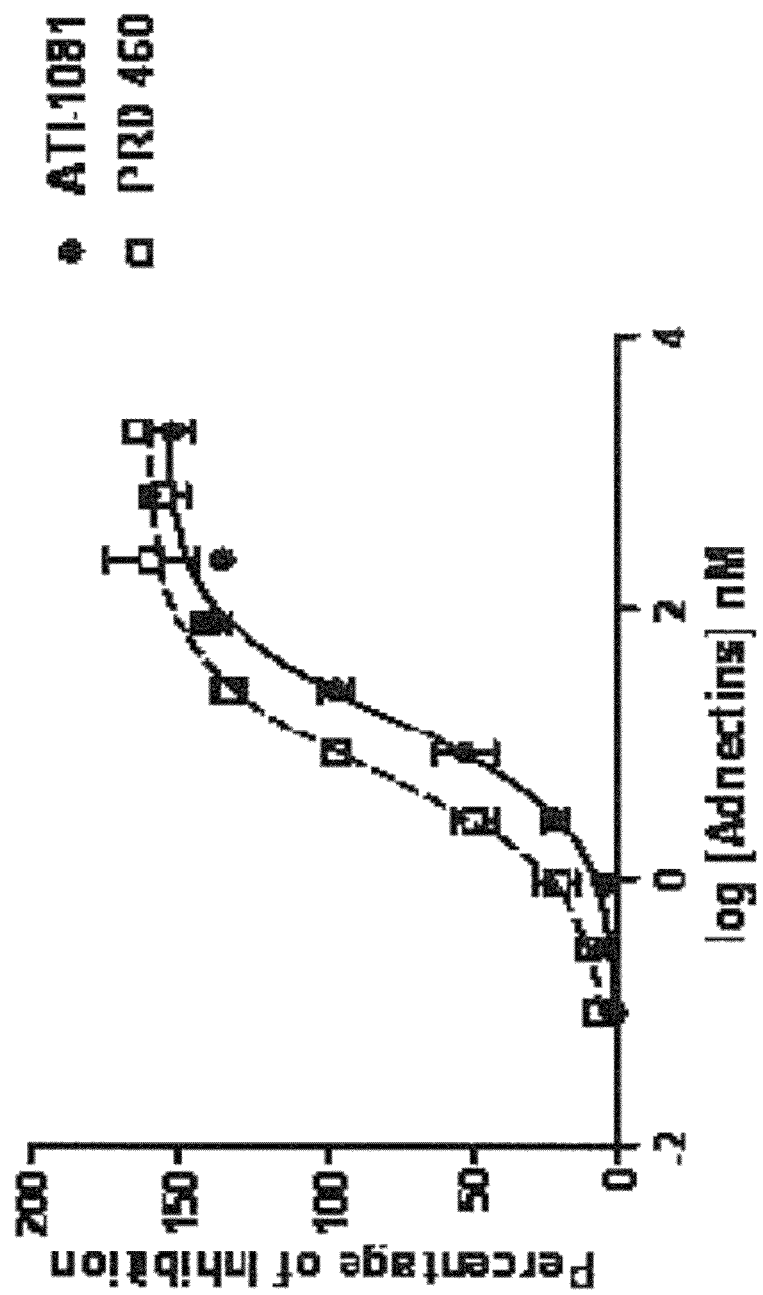

Using the PCSK9:ATI-972 FRET assay (at 5 nM human PCSK9), PRD460 inhibited with EC50=0.3 nM, compared to 0.8 nM for ATI-1114 and 2.8 nm for ATI-1081 (FIG. 15). These findings indicate that PRD460 potently displaced the biotinylated Adnectin ATI-972 from its binding site on PCSK9. The higher potency of PRD460 relative to ATI-1081 and ATI-1174 is consistent with bivalent binding by PRD460.

Inhibition of PCSK9-Induced LDLR Depletion in HepG2 Cells

Human PCSK9 promotes the depletion of LDLR from the surface of HepG2 cells. Pre-incubation of PCSK9 with PCSK9 Adnectins inhibits PCSK9 binding to LDLR and prevents the depletion of LDLR from the cell surface. This assay was used to measure the potency of ATI-1081, ATI-1174 and PRD460 to inhibit PCSK9 induced depletion of LDLR from the cell surface.

A dilution series of PCSK9 Adnectins were pre-incubated with 10 nM human PCSK9 for 1 hr at 37 degrees, the pre-incubated mixture was added to HepG2 cells, and the cells were incubated for 24 hours. Following this incubation, the level of LDLR on HepG2 cells was measured using FACS analysis. The percentage of inhibition of PCSK9-induced LDLR depletion was calculated and graphed (FIG. 15). In this assay ATI-1081, ATI-1174, and PRD460 inhibited PCSK9 with comparable EC50's (9 nM, 8 nM and 6 nM respectively) although a leftward-shift of the response curve was consistently observed for PRD460. These EC50's represent the limit of the assay.

PCSK9 Cell Entry Assay in HepG2 Cells

Figure 16:
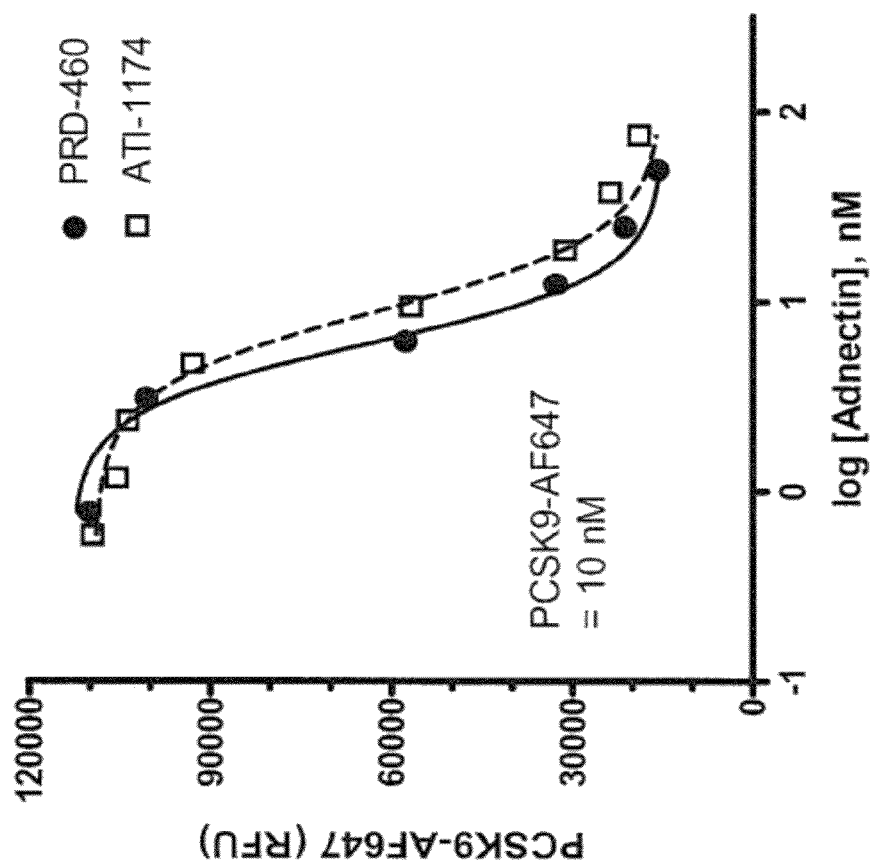
FIG. 16. Inhibition of PCSK9-AF647 cell entry in HepG2 cells.

PCSK9 binding to the LDLR on the surface of hepatocytes results in co-internalization of the LDLR-PCSK9 complex during LDLR endocytosis, leading to enhanced degradation of the LDLR. A cell-based assay was developed to measure LDLR-dependent cellular entry of fluorescent PCSK9. Human PCSK9 was covalently labeled using the fluorophore ALEXA FLUOR®-647(AF647). PCSK9-AF647 was incubated with HepG2 cells with or without PCSK9-Adnectins and the intracellular fluorescence was quantified by high content fluorescent microscopy and image analysis (Cellomics). Dependence of PCSK9-AF647 cell entry on LDLR endocytosis was established in preliminary experiments. HepG2 cells were incubated with 10 nM PCSK9-AF647 and varying levels of Adnectins for 4 hrs at 37 degrees. In this assay, potent inhibition of PCSK9-AF647 intracellular fluorescence was observed for PRD460 (EC50=6 nM) as well as for ATI-1174 (EC50=10 nM) (FIG. 16). These findings indicate that Adnectin PRD460 and ATI-1174 effectively blocked the binding of PCSK9 to cell surface LDLR in a human hepatic-derived cell line in culture, thereby reducing the internalization of PCSK9-AF647 during LDLR endocytosis.

In Vivo Transgenic Mouse Study

Figure 17:
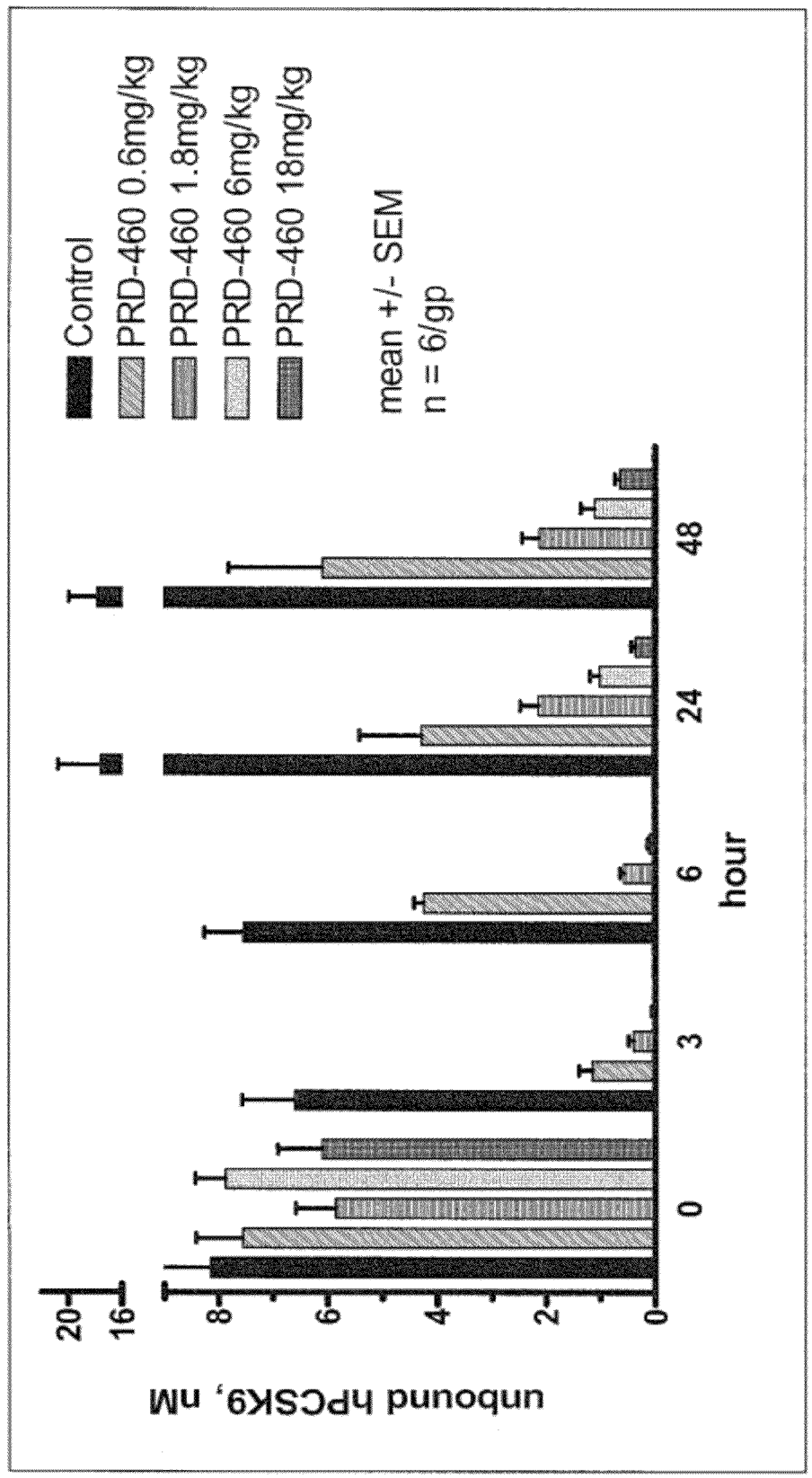
FIG. 17. Plasma unbound hPCSK9 levels in transgenic mice treated with PRD460 (dosed i.p.).

In vivo studies were conducted in the normal expresser hPCSK9 transgenic mouse model. Binding of Adnectins to PCSK9 in the plasma is predicted to result in a decrease in the measured amount of unbound (free) circulating PCSK9. The decrease in unbound PCSK9 is the initial pharmacodynamic event which results in inhibition of the PCSK9-LDLR interaction and in LDL cholesterol lowering. Administration of single doses of PRD460 (i.p. doses from 0.6 to 18 mg/kg) to the transgenic mice resulted in rapid, strong decreases in plasma unbound hPCSK9 levels (FIG. 17). Dose-dependent decreases in unbound PCSK9 were observed with ED50<0.6 mg/kg at the 3 hr time point. These findings in the normal expresser human PCSK9 transgenic mouse model show that PRD460 binds strongly and potently to circulating hPCSK9 in vivo.

In Vivo Pharmacodynamics in Cynomolgus Monkeys

Figure 18:
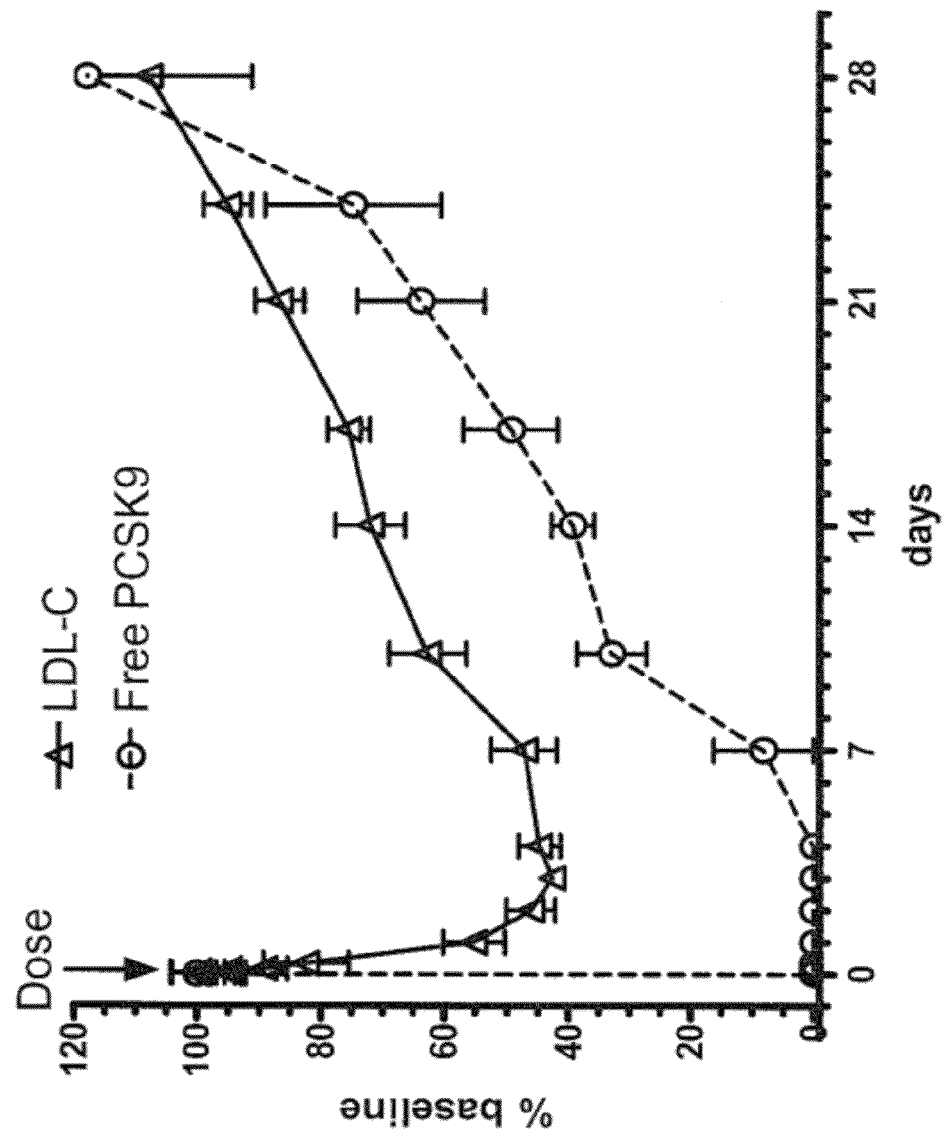
FIG. 18. Effect of PRD460 (15 mg/kg i.v.) on LDL-C and free PCSK9 in cyno monkeys (mean+/−SEM, n=3).

The pharmacodynamic effects of PCSK9 Adnectin PRD460 were evaluated in normal lean cynomolgus monkeys. PRD460 was administered to monkeys by i.v. dosing at 15 mg/kg, and plasma samples were collected at time intervals over 4 wks for the assay of LDL-C and free PCSK9 levels. A single dose of PRD460 rapidly lowered plasma LDL-C levels in the monkeys, reaching an average maximum effect of 42% of baseline LDL-C (58% reduction; n=3 monkeys) by day 3 after dosing (FIG. 18). LDL-C levels were reduced by 50% or more for a week at this dose, remaining significantly below baseline for 3 wks and returning to baseline by 4 wks. Total cholesterol showed a similar pattern but no effect on HDL was observed (not shown). Treatment with PRD460 caused an immediate drop to near zero (below the lower limit of quantitation) in the unbound, free form of plasma PCSK9 (FIG. 18). The free PCSK9 levels remained near the lower limits of detection for several days then gradually returned to baseline levels by the end of 4 wks, consistent with a cause/effect relationship with plasma LDL-C. The data indicate that plasma LDL lowering mirrored the drop in free PCSK9 levels, consistent with PCSK9 inhibition regulating LDLR function following treatment with PRD460 in vivo. Pharmacokinetic analysis revealed that the plasma half-life of Adnectin PRD460 was approximately 70 hrs in this cynomolgus monkey study. These findings indicate that a PCSK9 Adnectin-Fc fusion protein is highly efficacious and fast-acting with robust, specific, and long-lasting effects on LDL-C lowering in the cynomolgus monkey model.

In Vivo Pharmacological Evaluation of the Unmodified PCSK9 Adnectin, ATI-1081

In addition to modified Adnectins containing a PK moiety (e.g., PEGylated and Fc-fusion Adnectins), an unmodified ("naked") PCSK9 Adnectin can also be administered. Strategies for unmodified PCSK9 Adnectin treatment include more frequent dosing to accommodate the shorter PK half-life, or using an extended release subcutaneous formulation to increase the length of the absorption phase and extend the pharmacodynamic effect. Many such formulations can be envisioned including, as a simple example, propylene glycol/PBS solutions to delay the rate of absorption and increase the time of exposure to the Adnectin in the circulation.

Figure 19:
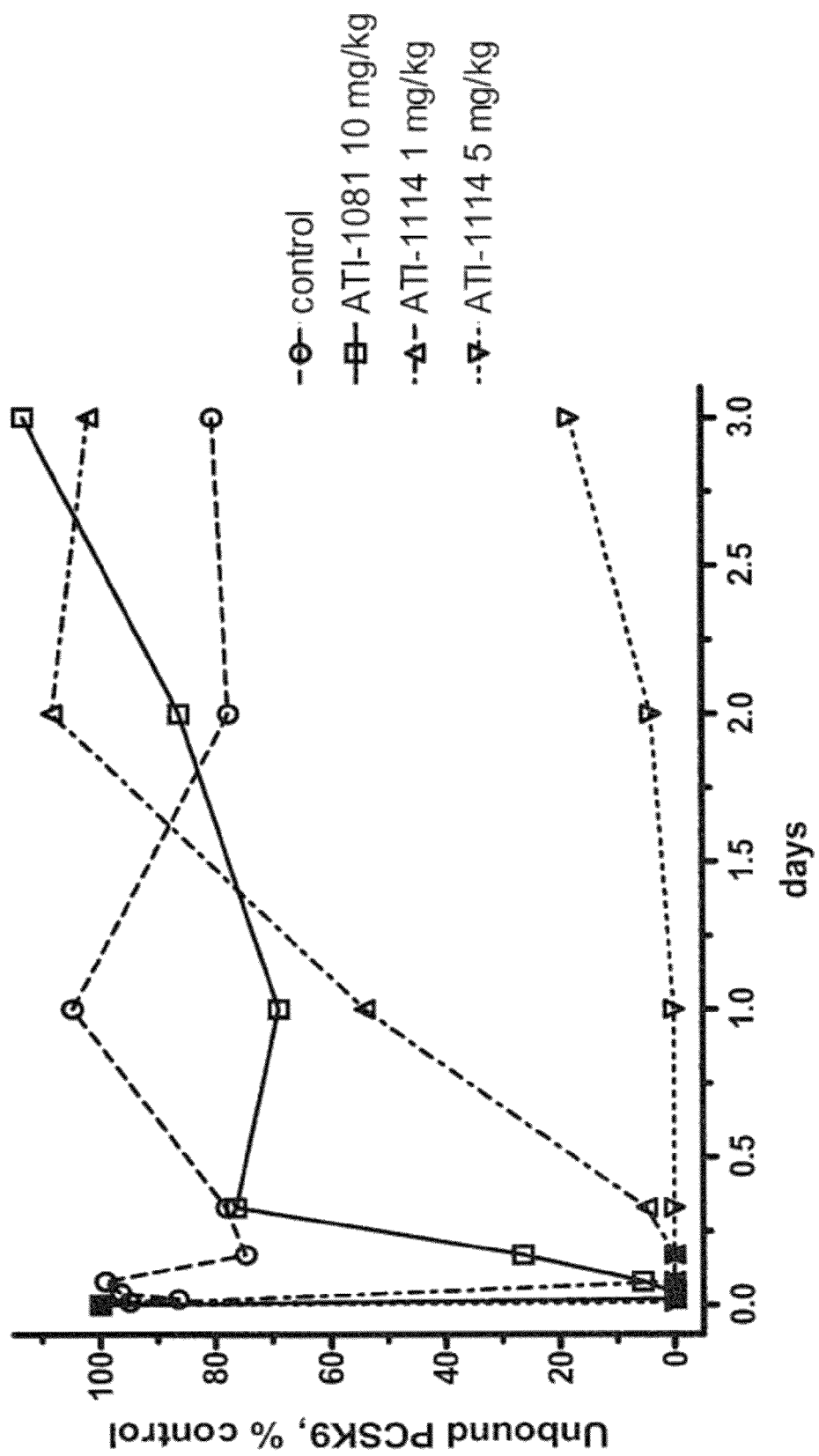
FIG. 19. Effect of ATI-1081 (also referred to as ATI001081) on unbound PCSK9 levels in cynomolgus monkeys.
Figure 20:
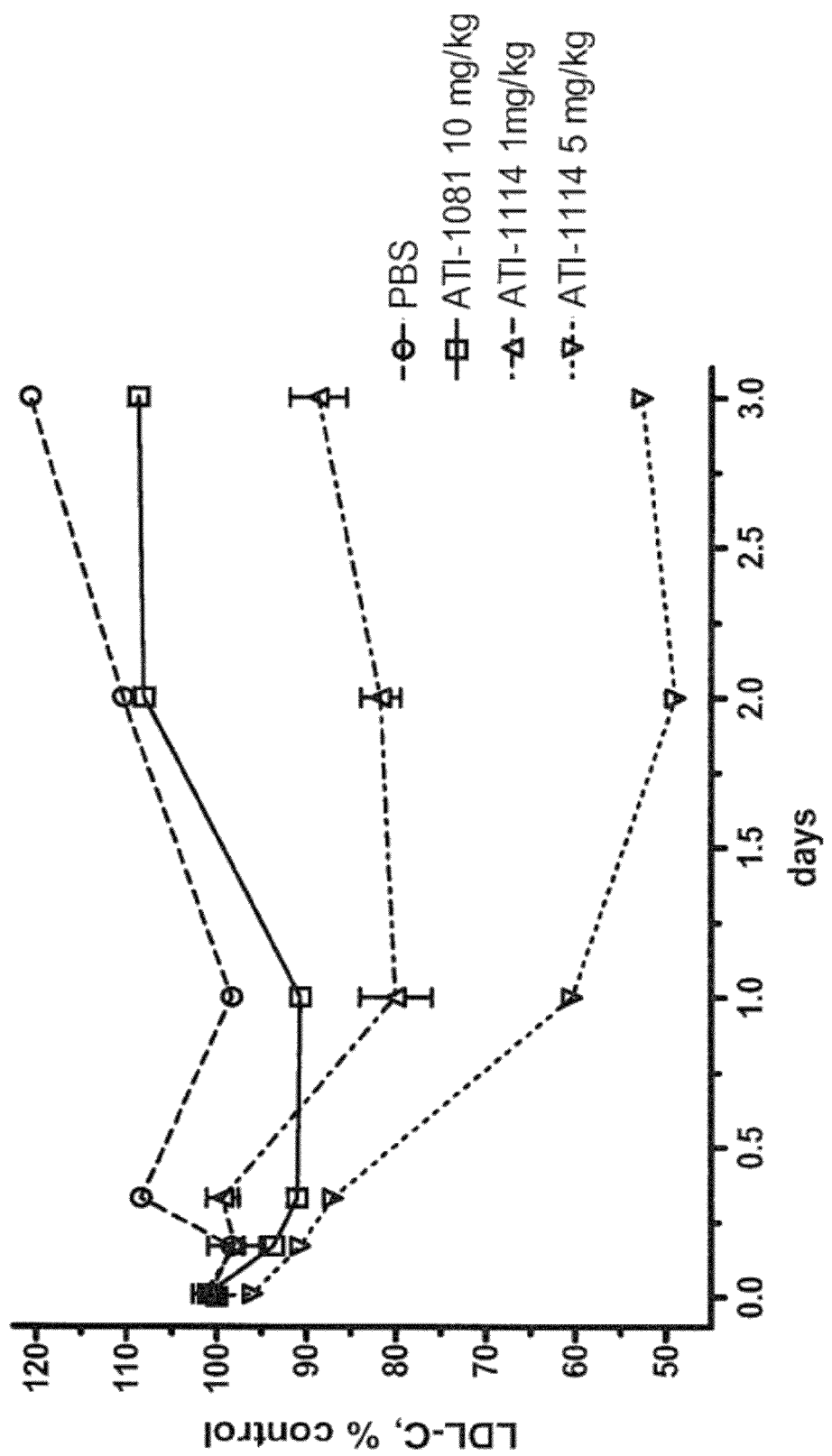
FIG. 20. Effect of ATI-1081 on LDL-C levels in cynomolgus monkeys.

The unmodified Adnectin ATI-1081 was administered to cynomolgus monkeys i.v. at 10 mg/kg in PBS vehicle. ATI-1114 (PEGylated version of the same Adnectin) was also administered at 1 mg/kg in PBS as a comparator. ATI-1081 elicited a rapid, transient inhibition of unbound circulating PCSK9 levels. Within 30 minutes the extent of initial inhibition approached 100% (below the limits of quantitation) before returning to baseline several hours later (FIG. 19). Concurrently, a trend to lower LDL-C levels was observed over the first 24 hrs in the ATI-1081 treated monkeys (FIG. 20).

Figure 21:
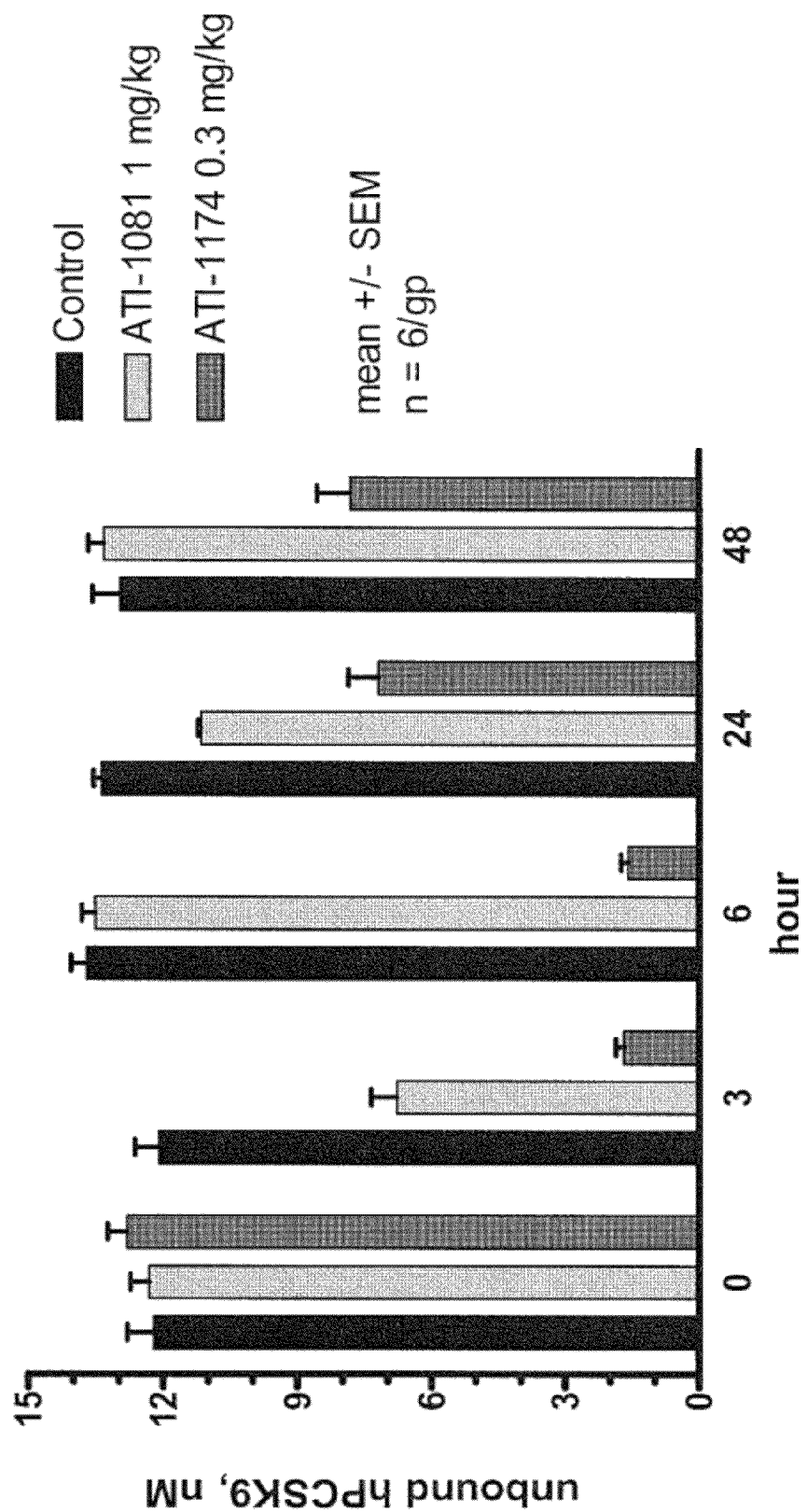
FIG. 21. Effect of ATI-1081 in PBS vehicle in transgenic mice. The figure illustrates level of unbound plasma hPCSK9 in transgenic mice.
Figure 22:
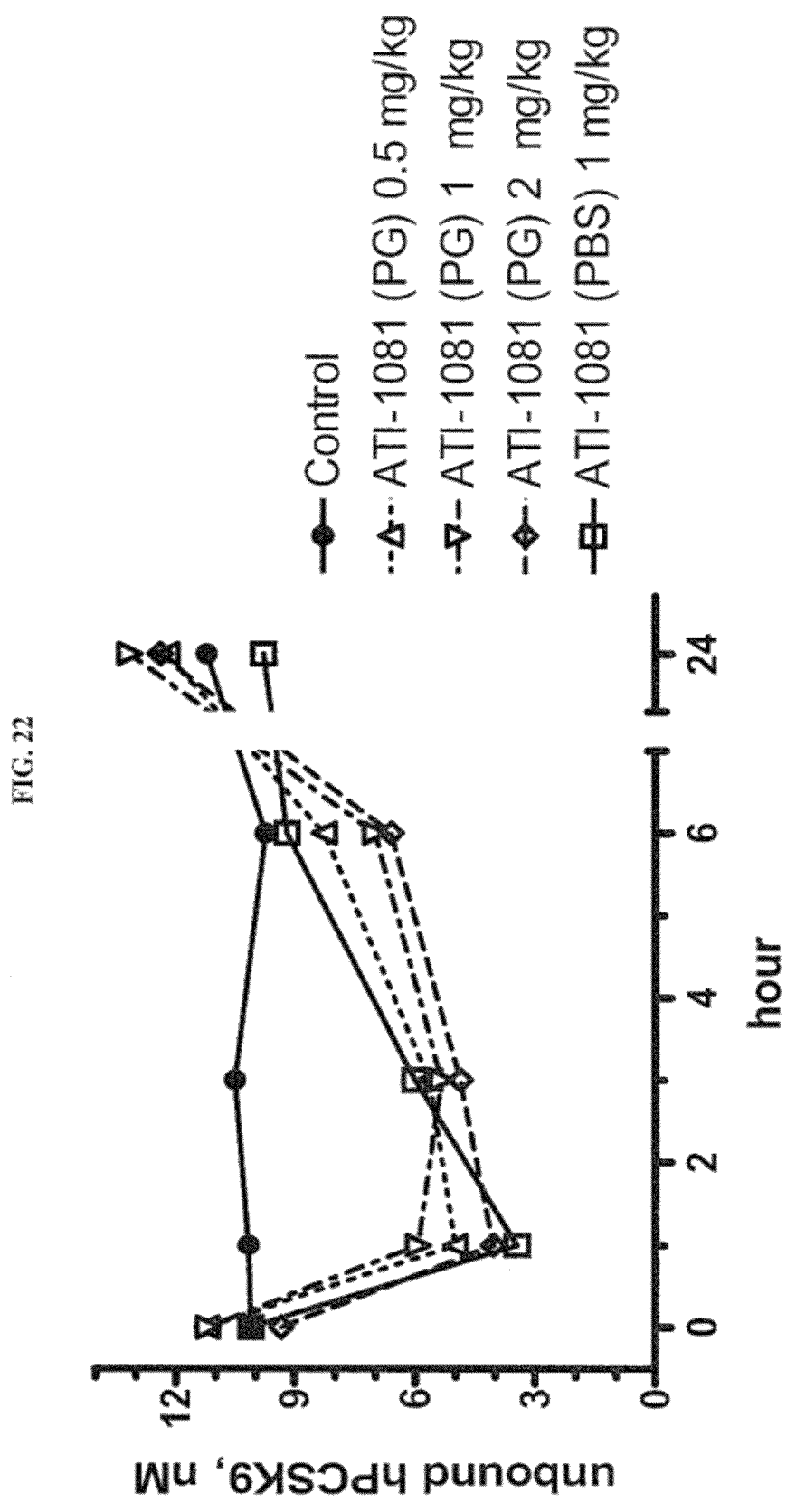

The unmodified Adnectin ATI-1081 was also administered to the normal expresser hPCSK9 transgenic mice in a simple extended release subcutaneous formulation using 50:50 propylene glycol:PBS vehicle (PG vehicle) compared to PBS vehicle. This formulation is expected to modestly delay the rate of Adnectin absorption and increase the exposure time to ATI-1081 in the circulation, thus improving the pharmacodynamic response. Administration (intraperitoneal) of ATI-1081 at 1 mg/kg in PBS vehicle resulted in ~50% lowering of unbound plasma PCSK9 at 3 hr, compared to >85% lowering for ATI-1114 at 0.3 mg/kg (FIG. 21). In a second experiment in the transgenic mice, ATI-1081 administered by subcutaneous injection in PG vehicle resulted in nearly equivalent decreases in unbound LDL compared to ATI-1174, with an improved duration of effect over the first 6 hrs of the study (FIG. 22). These findings indicate that the unmodified PCSK9 Adnectin ATI-1081 when administered subcutaneously in a simple extended release vehicle bound to the target human PCSK9 in vivo and elicited the initial pharmacodynamic response. The time dependency of the response was consistent with extended release prolonging the duration of effect for the unmodified PCSK9 Adnectin.

Example 5

Serum Albumin-Binding Adnectins (SABA)

Example 5A

Screening and Selection of Candidate Serum Albumin-Binding Adnectin

Overview

A selection technique known as PROfusion (see e.g., Roberts et al., *Proc. Natl. Acad. Sci. USA*, 94(23):12297-12302 (1997) and WO 2008/066752) was applied to a DNA library with variable regions designed into the BC, DE and FG loops of $^{10}$Fn3. A random library of greater than $10^{13}$ molecules was created from this design, and selection pressure was applied against a biotinylated form of HSA to isolate candidate serum albumin-binding Adnectin (SABA) with desirable binding properties.

High Throughput Protein Production (HTTP) Process

The various HSA binding Adnectins were purified using a high throughput protein production process (HTPP). Selected binders were cloned into pET9d vector containing a HIS6 tag and transformed into *E. coli* BL21(DE3)pLysS cells. Transformed cells were inoculated in 5 ml LB medium containing 50 µg/mL Kanamycin in a 24-well format and grown at 37° C. overnight. Fresh 5 ml LB medium (50 µg/mL Kanamycin) cultures were prepared for inducible expression by aspirating 200 µl from the overnight culture and dispensing it into the appropriate well. The cultures were grown at 37° C. until $A_{600}$ 0.6-0.9. After induction with 1 mM isopropyl-β-thiogalactoside (IPTG), the culture was grown for another 4 hours at 30° C. and harvested by centrifugation for 10 minutes at 3220×g at 4° C. Cell Pellets were frozen at −80° C.

Cell pellets (in 24-well format) were lysed by resuspension in 450 µl of Lysis buffer (50 mM $NaH_2PO_4$, 0.5 M NaCl, 1× Complete Protease Inhibitor Cocktail-EDTA free (Roche), 1 mM PMSF, 10 mM CHAPS, 40 mM Imidazole, 1 mg/ml lysozyme, 30 ug/ml DNAse, 2 ug/ml aprotonin, pH 8.0) and shaken at room temperature for 1 hour. Lysates were clarified and re-racked into a 96-well format by transfer into a 96-well Whatman GF/D UNIFILTER® fitted with a 96-well, 650 µl catch plate and centrifuged for 5 minutes at 200×g. The clarified lysates were transferred to a 96-well Ni-Chelating Plate that had been equilibrated with equilibration buffer (50 mM $NaH_2PO_4$, 0.5 M NaCl, 10 mM CHAPS, 40 mM Imidazole, pH 8.0) and incubated for 5 min. Unbound material was removed. The resin was washed 2×0.3 ml/well with Wash buffer #1 (50 mM $NaH_2PO_4$, 0.5 M NaCl, 5 mM CHAPS, 40 mM Imidazole, pH 8.0). Next the resin was washed with 3×0.3 ml/well with PBS. Prior to elution each well was washed with 50 µl Elution buffer (PBS+20 mM EDTA), incubated for 5 min and this wash discarded by vacuum. Protein was eluted by applying an additional 100 ul of Elution buffer to each well. After 30 minute incubation at room temperature the plate(s) were centrifuged for 5 minutes at 200×g and eluted protein collected in 96-well catch plates containing 5 µl of 0.5M $MgCl_2$ affixed to the bottom of the Ni-plates. Eluted protein was quantified using a BCA Protein assay with SGE (control Adnectin) as the protein standard. The SGE Adnectin is a wild-type $^{10}$Fn3 domain (SEQ ID NO: 1) in which integrin binding domain (amino acids RGD at positions 78-80) have been replaced with SGE.

HSA, RhSA and MuSA Direct Binding ELISA

For assaying direct binders to HSA, MaxiSorp plates (Nunc International, Rochester, N.Y.) were coated with 10 ug/mL HSA (Sigma, St. Louis, Mo.) in PBS at 4° C. overnight followed by blocking in casein block buffer (Thermo Scientific, Rockford, Ill.) for 1-3 hours at room temperature. For single-point screening assays, purified HTPP Adnectin were diluted 1:20 in casein block buffer and allowed to bind to HSA in each well for 1 hour at room temperature. For dose response assays, concentrations ranging from 0.1 nM up to 1 µM were used. After washing in PBST to remove unbound Adnectins, anti-His mAb-HRP conjugate (R&D Systems, MN) diluted 1:2500 in casein block buffer was added to the bound His-tagged Adnectin for 1 hour at room temperature. Excess conjugate was removed by washing with PBST and bound Adnectins detected using TMB detection reagents (BD Biosciences) according to the manufacturer's instructions.

Aggregation Measurement by Analytical Size Exclusion Chromatography

Size exclusion chromatography (SEC) was performed on the SABAs resulting from the HTPP. SEC of HTPP derived material was performed using a SUPERDEX® 200 5/150 or SUPERDEX® 75 5/150 column (GE Healthcare) on an Agilent 1100 or 1200 HPLC system with UV detection at $A_{214}$ nm and $A_{280}$ nm and with fluorescence detection (excitation=280 nm, emission=350 nm). A buffer of 100 mM sodium sulfate, 100 mM sodium phosphate, 150 mM sodium chloride, pH 6.8 at appropriate flow rate of the SEC column employed. Gel filtration standards (Bio-Rad Laboratories, Hercules, Calif.) were used for molecular weight calibration.

The results of the SEC on the HTPP purified SABAs were shown to be predominantly monomeric and eluted in the approximate range of 10 kDa vs. globular Gel Filtration standards (BioRad).

Identification of Candidate Serum Albumin-Binding Adnectin (SABA)

As a result of the screening for HSA/RhSA/MuSA binding and biophysical criteria, four unique serum albumin-binding Adnectins (SABA) were identified and chosen to have their half-lives evaluated in mice. In order to carry out in vitro and in vivo characterization, midscales were undertaken for the four SABAs. Table 6 provides the sequences of twenty-six unique SABA core sequences identified from PROfusion, designated as SABA 1-26. SABA4 had a scaffold mutation that was fixed prior to midscaling. The scaffold-perfect version of SABA4 is SABA5. SABA4 and SABA5 have identical sequences in the BC, DE, and FG loops.

Example 5B

Production and Formulation of Candidate SABAs
Midscale Protein Production of SABAs The selected SABAs described in Example 5A, followed by the $His_6$tag, were cloned into a pET 9d vector and expressed in *E. coli* BL21(DE3)pLysS cells (see Table 6 for each His-tagged SABA sequence designated SABA1.1, SABA2.1, SABA3.1, and SABA5.1). 20 ml of an inoculum culture (generated from a single plated colony) was used to inoculate 1 liter of LB medium containing 50 μg/mL Kanamycin. The culture was grown at 37° C. until $A_{600}$ 0.6-1.0. After induction with 1 mM isopropyl-β-thiogalactoside (IPTG) the culture was grown for another 4 hours at 30° C. and harvested by centrifugation for 30 minutes at ≧10,000×g at 4° C. Cell Pellets were frozen at −80° C. The cell pellet was resuspended in 25 mL of lysis buffer (20 mM $NaH_2PO_4$, 0.5 M NaCl, 1×Complete Protease Inhibitor Cocktail-EDTA free (Roche), pH 7.4) using an ULTRA-TURRAX® homogenizer (IKA works) on ice. Cell lysis was achieved by high pressure homogenization (≧18,000 psi) using a Model M-110S MICROFLUIDIZER® (Microfluidics). The soluble fraction was separated by centrifugation for 30 minutes at 23,300×g at 4° C. The supernatant was clarified via 0.45 μm filter. The clarified lysate was loaded onto a HISTRAP® column (GE) pre-equilibrated with 20 mM $NaH_2PO_4$, 0.5 M NaCl, pH 7.4. The column was then washed with 25 column volumes of 20 mM $NaH_2PO_4$, 0.5 M NaCl, pH 7.4, followed by 20 column volumes of 20 mM $NaH_2PO_4$, 0.5 M NaCl, 25 mM imidazole pH 7.4, and then 35 column volumes of 20 mM $NaH_2PO_4$, 0.5 M NaCl, 40 mM imidazole pH 7.4. Protein was eluted with 15 column volumes of 20 mM $NaH_2PO_4$, 0.5 M NaCl, 500 mM imidazole pH 7.4, fractions pooled based on absorbance at $A_{280}$ and dialyzed against 1×PBS, 50 mM Tris, 150 mM NaCl pH 8.5 or 50 mM NaOAc; 150 mM NaCl; pH 4.5. Any precipitate was removed by filtering at 0.22 μm.

Midscale expression and purification yielded highly pure and active Adnectins that were expressed in a soluble form and purified from the soluble fraction of the bacterial cytosol. SEC analysis on a SUPERDEX® 200 or SUPERDEX® 75 10/30GL in a mobile phase of 100 mM $NaPO_4$, 100 mM $NaSO_4$, 150 mM NaCl, pH 6.8 (GE Healthcare) demonstrated predominantly monomeric Adnectins.

Formulation of SABA1.2

One specific SABA, SABA1.2 (SEQ ID NO: 411), was chosen for a preliminary formulation screen. SABA1.2 comprises an $(ED)_5$ extension on the "core 1" sequence of $^{10}Fn3$ (see SEQ ID NO: 421 in Table 6). For SABA1.2, a stable formulation of 10 mM succinic acid, 8% sorbitol, 5% glycine at pH 6.0 and at a product concentration of 5 mg/mL was identified. In this formulation the protein melting temperature was 75° C. as determined by Differential Scanning calorimetry (DSC) using a protein concentration of 1.25 mg/mL. The formulation provided satisfactory physical and chemical stability at 4° C. and 25° C., with an initial aggregate level at 1.2%. After one month of stability, the level of aggregation was very low (1.6% at 4° C. and 3.8% at 25° C.). The protein was also stable in this formulation after five cycles of freeze-thaw as transitioned from −80° C. and −20° C. to ambient temperature. In addition, in this formulation SABA1.2 was soluble to at least 20 mg/mL protein concentration at 4° C. and ambient temperature with no precipitation or increase in aggregation.

Example 5C

Biophysical Characterization of Candidate SABAs

Size Exclusion Chromatography

Standard size exclusion chromatography (SEC) was performed on the candidate SABAs resulting from the midscale process. SEC of midscaled material was performed using a SUPERDEX® 200 10/30 or on a SUPERDEX® 75 10/30 column (GE Healthcare) on an Agilent 1100 or 1200 HPLC system with UV detection at $A_{214}$ nm and $A_{280}$ nm and with fluorescence detection (excitation=280 nm, emission=350 nm). A buffer of 100 mM sodium sulfate, 100 mM sodium phosphate, 150 mM sodium chloride, pH 6.8 at appropriate flow rate of the SEC column employed. Gel filtration standards (Bio-Rad Laboratories, Hercules, Calif.) were used for molecular weight calibration.

The results of the SEC on the midscaled purified SABAs showed predominantly monomeric Adnectin and elution in the approximate range of 10 kDa vs. globular Gel Filtration standards (BioRad) as showed.

Thermostability

Differential Scanning calorimetry (DSC) analyses of the midscaled SABAs were performed to determine their respective $T_m$'s. A 1 mg/ml solution was scanned in a N-DSC II calorimeter (calorimetry Sciences Corp) by ramping the temperature from 5° C. to 95° C. at a rate of 1 degree per minute under 3 atm pressure. The data was analyzed vs. a control run of the appropriate buffer using a best fit using Orgin Software (OrginLab Corp). The results of the SEC and DSC analyses are summarized in Table 14.

TABLE 14

Summary of SEC and DSC Analyses on Candidate SABAs

| Clone | SEC Monomer (%) | SEC Dimer (%) | DSC (Tm) |
|---|---|---|---|
| SABA1.1 | 92.3 | 7.7 | 63.9° C. |
| SABA5.1 | 88 | 12 | 70.1° C. |
| SABA2.1 | 91 | 9 | 58.5° C./78.2° C. |
| SABA3.1 | 99 | BLD | 65.2° C. |

Example 5D

Characterization of Candidate SABA1 Binding to Serum Albumin

The kinetics of selected SABA clones purified from HTPP and/or midscaled material described in Examples 5A and 5B were determined by capturing the respective serum albumin (HSA/RhSA/MuSA) on the surface of a Biasensor CMS chip and flowing a concentration series of SABAs over both the reference flow cell and the captured albumins. In addition, binding to albumin was carried out under various pH conditions ranging from pH 5.5 to pH 7.4. HSA-binding Adnectins SABA2.1, SABA3.1, SABA4.1, and SABA1.1 cross reacted with RhSA but did not cross react with MuSA. SABA2 and SABA4 binding is pH sensitive whereas clone SABA3 demonstrated pH resistance binding to HSA down to pH 6.0. SABA1.1 fits biochemical criteria for pH resistance and affinity/kinetics down to pH 5.5.

Domain mapping was determined by BIACORE®. Selected SABA clones purified from HTPP and/or midscaled material were determined by capturing HSA or a construct consisting of just HSA-domain I & II or HSA-domain III on the surface of a Biasensor CMS chip and flowing a concentration series of the SABAs over both the reference flow cell and the captured albumins. Clones SABA2 & SABA1 bound to HSA and the HSA-domain I-II construct but not the HSA-domain III construct. Clones SABA3 & SABA4 bound to HSA but not to either the HSA-domain I-II or HSA-domain III constructs. The results are summarized in Table 15.

TABLE 15

Binding Affinity and Kinetics of Candidate SABAs (SABA1.1, 2.1, 3.1 and 4.1)

| Adnectin | Target | $K_D$ (nM) | $K_{off}(s^{-1})$ | Resistant to pH 7.4→5.5? | Epitope on HSA |
|---|---|---|---|---|---|
| SABA2 | HSA | 33.8 +/− 20.5 (n = 6) | 1.71E−04 | --- | Domain I-II |
|  | RhSA | 63.6 | 4.42E−04 |  |  |
| SABA3 | HSA | 863 | 6.82E−02 | +++ (down to pH 6.0) | Neither domain I-II nor III |
|  | RhSA | 431 | 3.37E−02 |  |  |

TABLE 15-continued

Binding Affinity and Kinetics of Candidate SABAs
(SABA1.1, 2.1, 3.1 and 4.1)

| Adnectin | Target | $K_D$ (nM) | $K_{off}(s^{-1})$ | Resistant to pH 7.4→5.5? | Epitope on HSA |
|---|---|---|---|---|---|
| SABA4 | HSA | 412 +/− 8 (n = 4) | 7.82E−04 | -- | (interfacial?) Neither domain I-II nor III |
| | RhSA | >1000 | 3.83E−03 | | (interfacial?) |
| SABA1 | HSA | 47.2 +/− 18.2 (n = 9) | 4.57E−04 | +++ | Domain I-II |
| | RhSA | 778 +/− 313 (n = 4) | 5.45E−03 | | |

Example 5E

Examination of the In Vivo $t_{1/2}$ of Candidate SABAs

Figure 23:
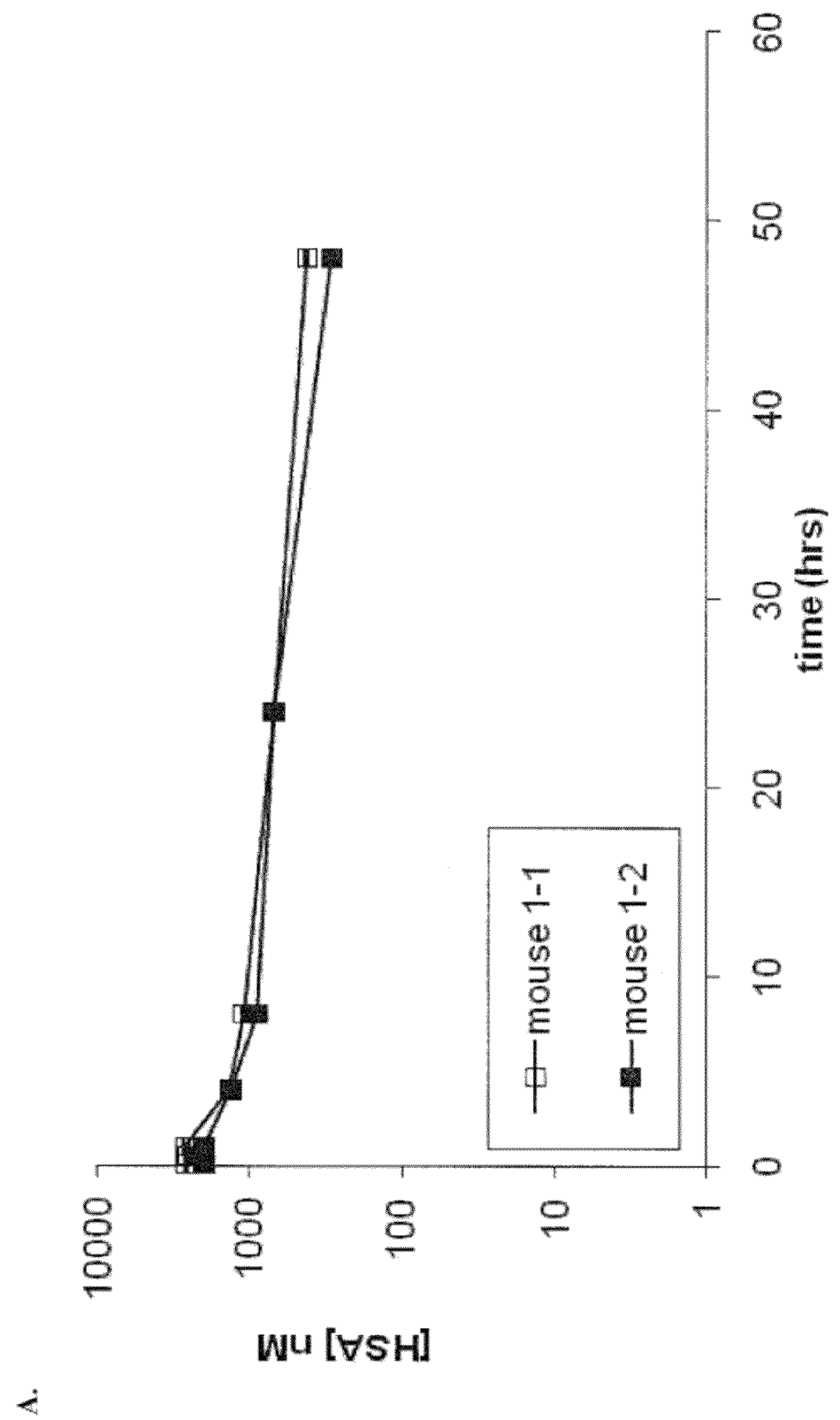
FIG. 23. In vivo HSA half-life in mice. HSA was injected into nude mice at 20 mg/kg (panel A) or 50 mg/kg (panel B).
Figure 23:
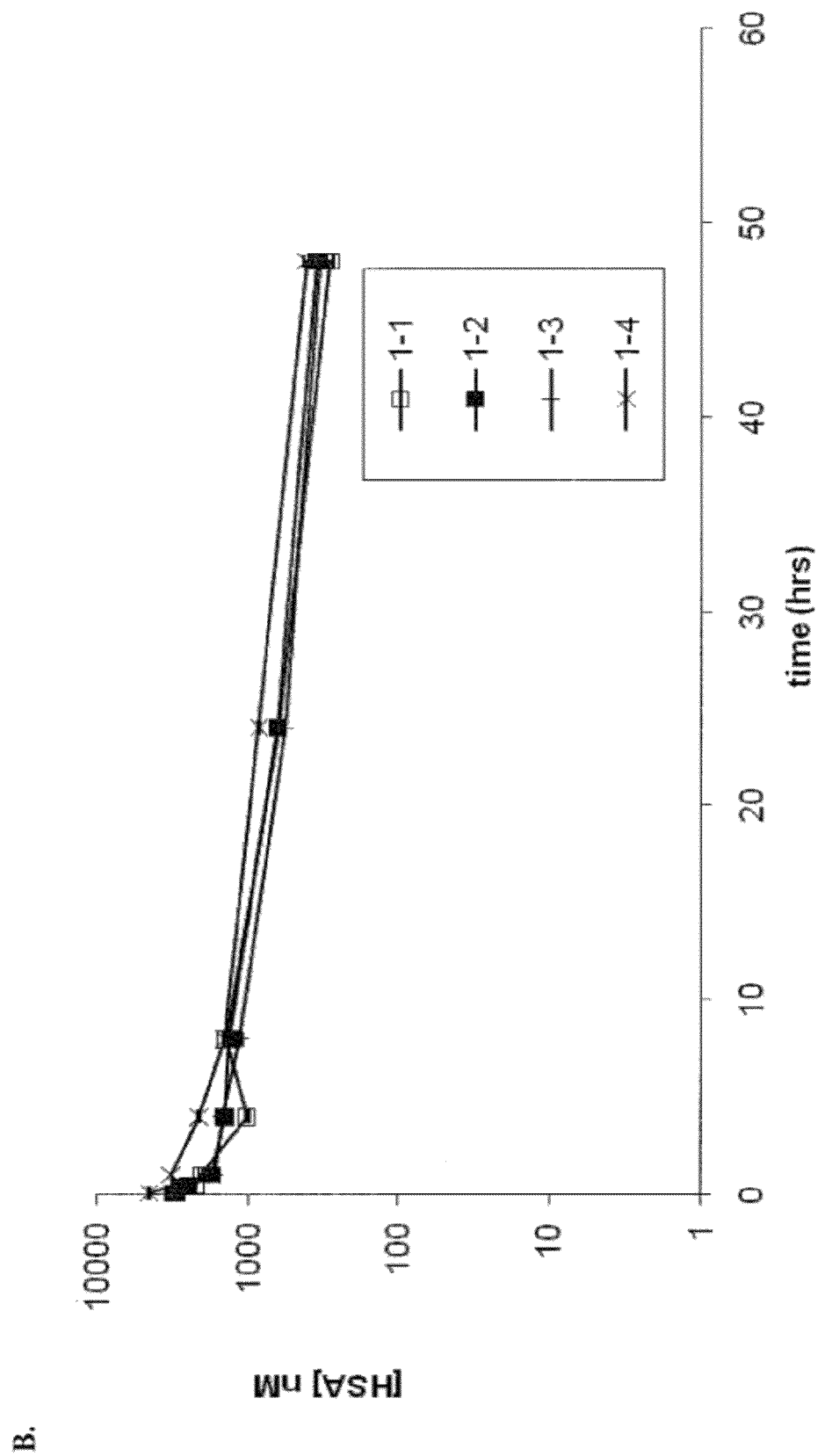

The half-life of HSA in mice was determined to allow for evaluation of HSA-binding Adnectins in mice as the HSA-binding Adnectins do not cross react with MuSA. HSA was injected into the tail vein of approximately 6 week old Ncr nude female mice at a 20 mg/kg (FIG. 23A) and 50 mg/kg dose (FIG. 23B), and the concentration of HSA in blood samples taken at intervals post-injection was determined by ELISA. The $t_{1/2}$ of HSA injected into mice at 20 mg/kg and 50 mg/kg were determined to be ~24 hrs and ~20 hrs, respectively.

Half-Life Determination of SABA1-4 in Mice

One liter *E. coli* growth of HSA binding clones SABA1.1, SABA2.1, SABA3.1, and SABA4.1 were prepared, purified and endotoxin removed. Each SABA variant was injected into the tail vein of mice, and the concentration in blood samples taken at intervals post-injection was determined by ELISA.

Figure 24:
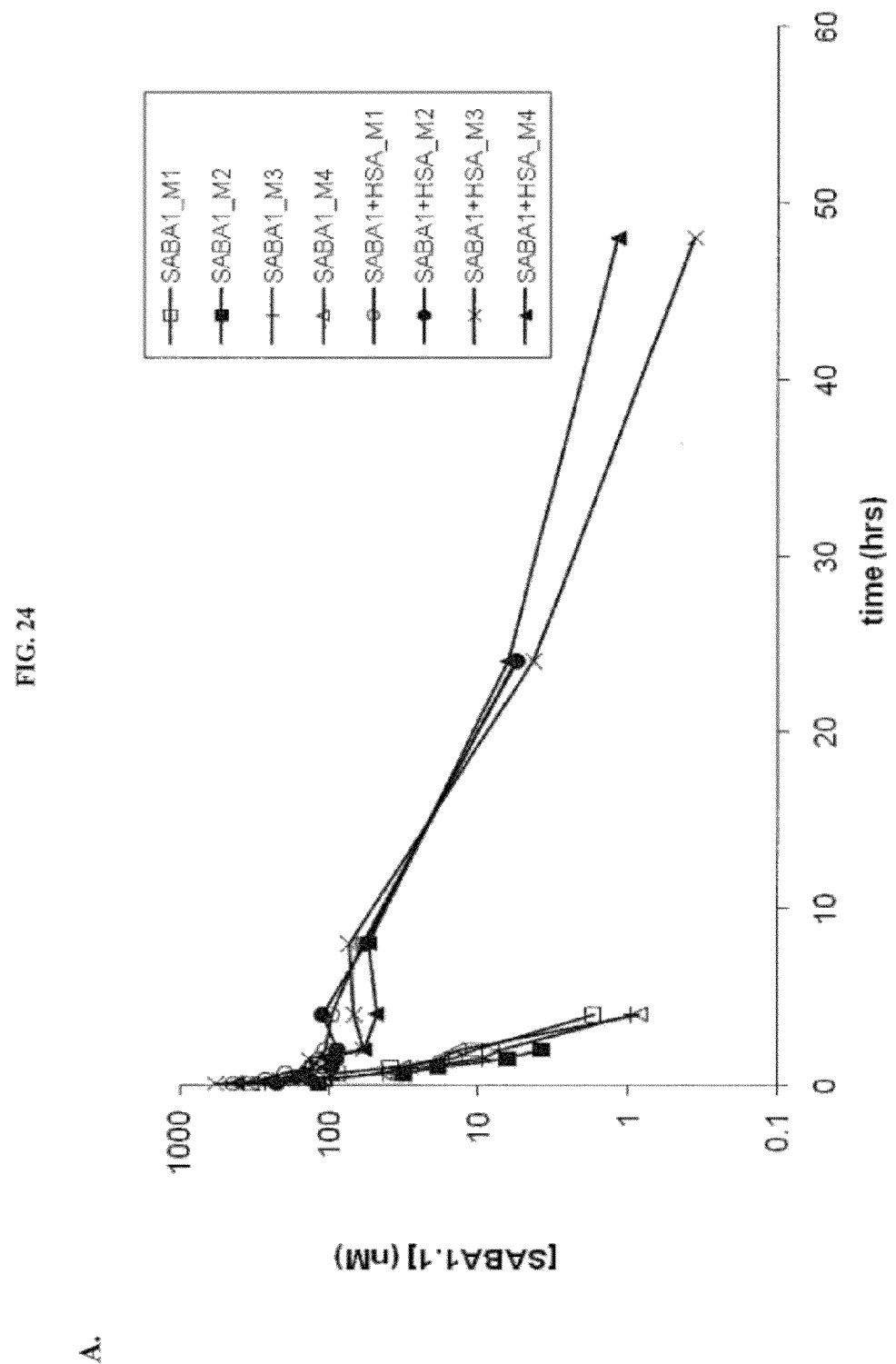
FIG. 24. Half-life determination of SABA 1.1 (panel A), SABA2.1 (panel B), SABA3.1 (panel C), and SABA4.1 (panel D) in mice.
Figure 24:
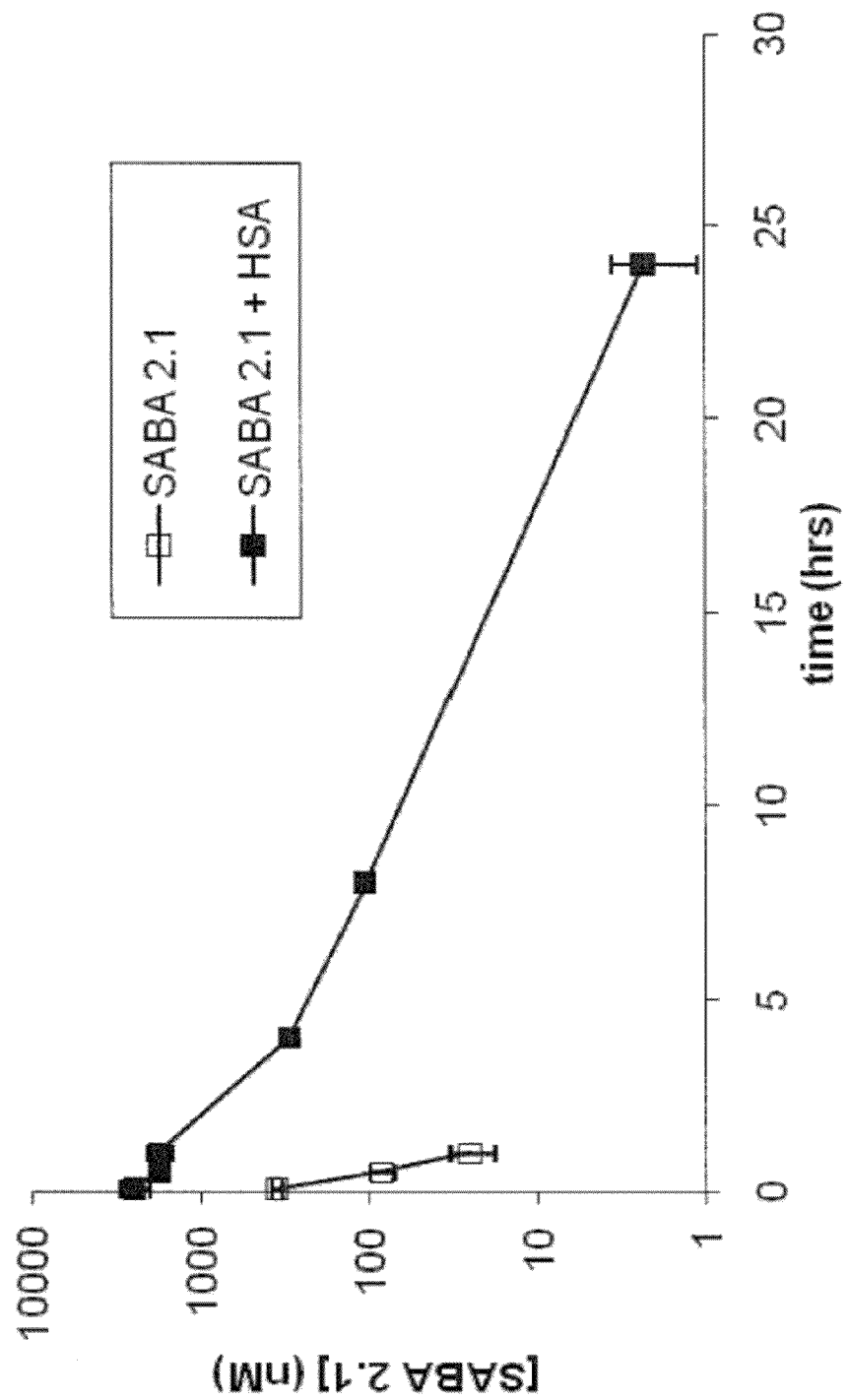
Figure 24:
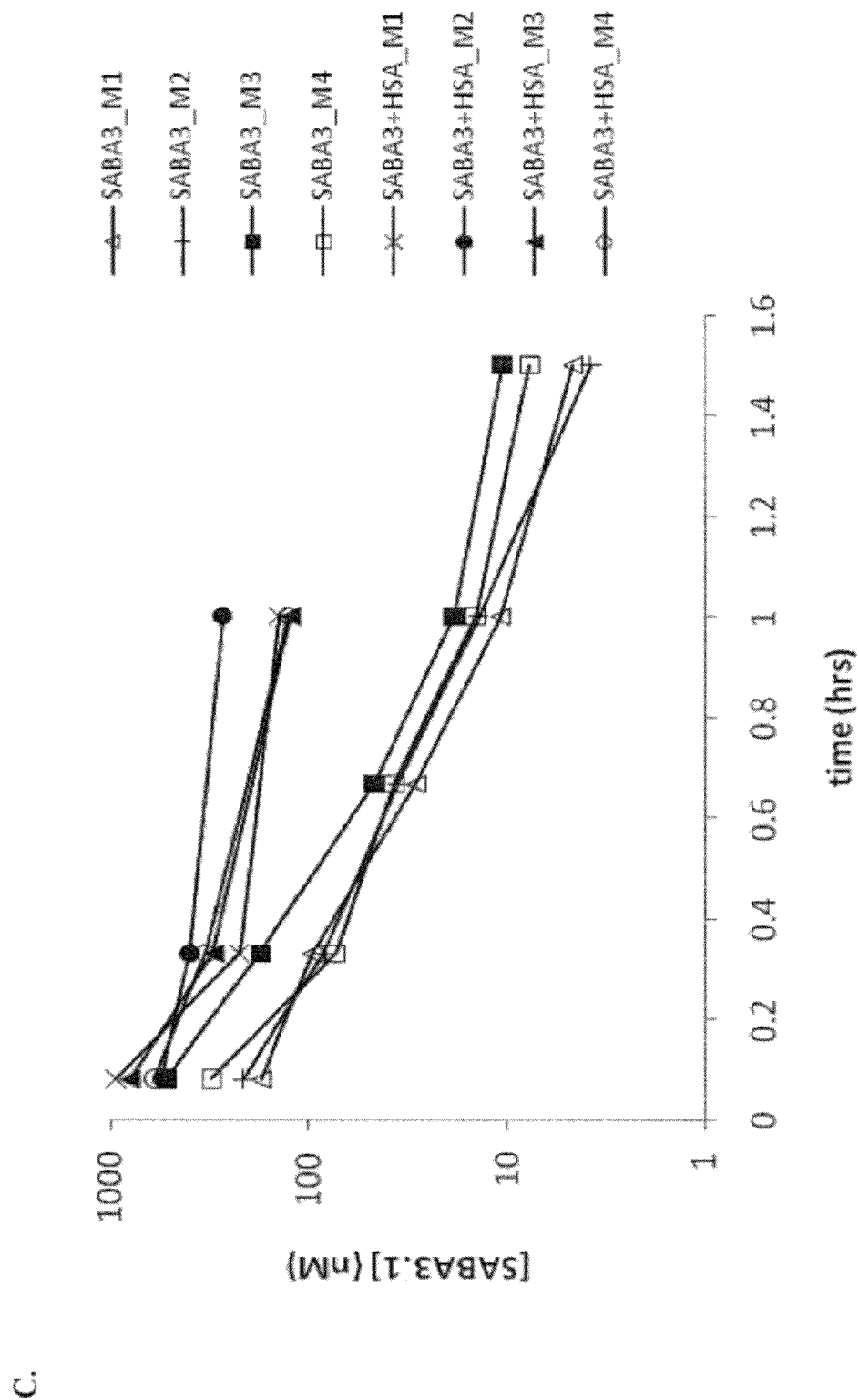
Figure 24:
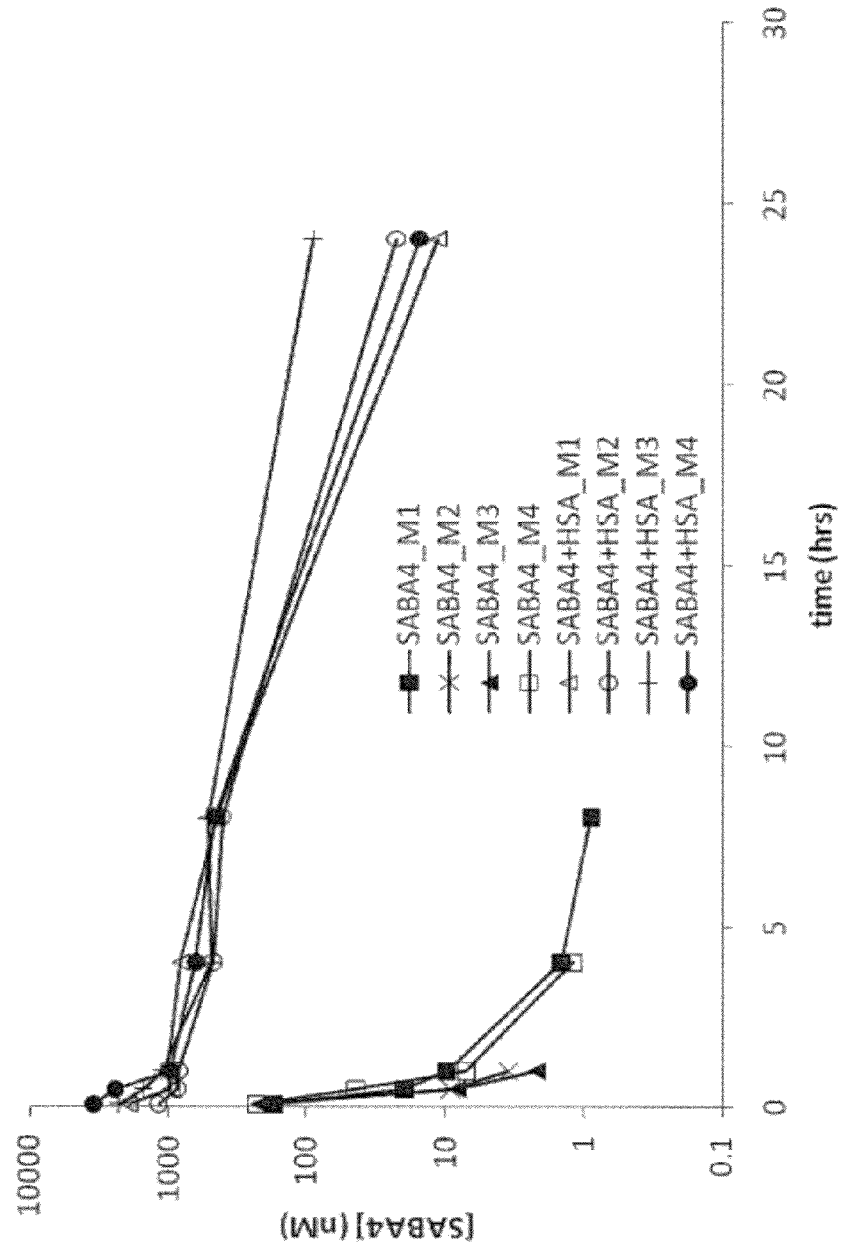
Figure 25:
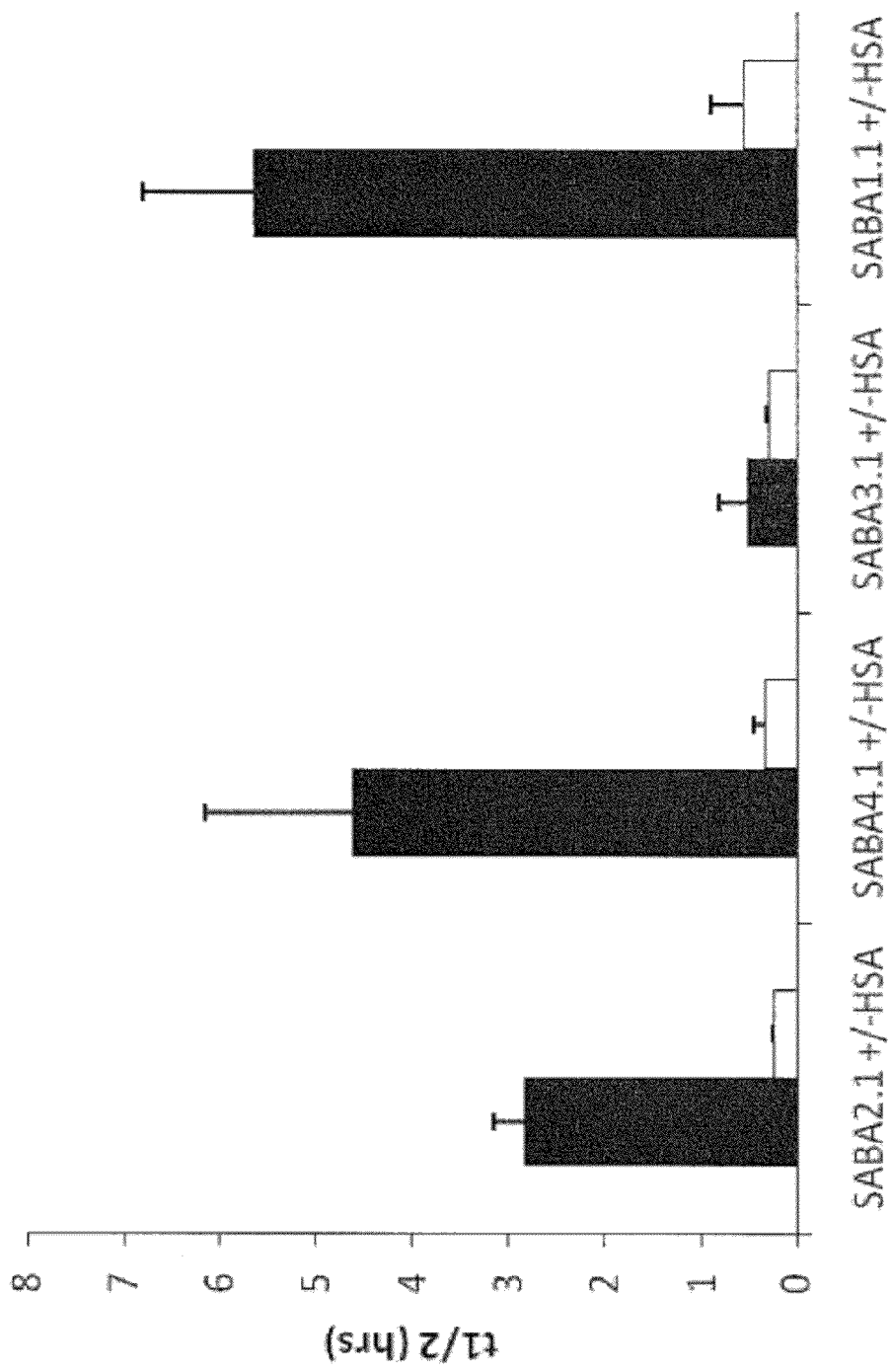
FIG. 25. Graph showing summary of half-life enhancement in mice of SABA1-4 when co-injected with HSA.

The pharmacokinetic profiles of each SABA were compared in the presence or absence of HSA in approximately 6 week old Ncr nude female mice. The mice that were co-injected with HSA had the HSA premixed with each SABA (HSA in a 3-4 molar excess) because the binding clone was selective for HSA and RhSA and did not bind the mouse serum albumin. The half-life of SABA1.1 (clone 1318H04) in mice plasma was 0.56 hours whereas the half-life of SABA1.1 co-injected with HSA was 5.6 hours, a ~10-fold increase in half life (FIG. 24A). The half-life of SABA2.1 in mice plasma was 0.24 hours whereas the half-life of SABA2.1 co-injected with HSA was 2.8 hours, a ~12-fold increase in half life (FIG. 24B). The half-life of SABA3.1 (clone 1245H07) in mice plasma was 0.28 hours whereas the half-life of SABA3.1 co-injected with HSA was 0.53 hours, a ~2-fold increase in half life (FIG. 24C). The half-life of SABA4.1 in mice plasma was 0.66 hours whereas the half-life of SABA4 co-injected with HSA was 4.6 hours, a ~7-fold increase in half life (FIG. 24D). A summary of the present example is shown in FIG. 25. Table 16 summarizes similar data for SABA1.1, SABA2.1, SABA3.1, and SABA5.1; comparison is made to half life in cyno, where available.

TABLE 16

| | PK (T½) | | |
|---|---|---|---|
| CLONE | Mice | Cyno | Comments |
| SABA1.1 | 5.6 hrs | 96-137 hrs | T½ = 96-137 hrs |
| SABA5.1 | 4.6 hrs | 12 hrs | Poor binding affinity for RhSA. 2-fold decrease in KD observed at pH < 6.0 |
| SABA2.1 | 2.8 hrs | NA | Loss of binding at pH < 6.5 |
| SABA3.1 | 32 min | NA | Poor T½ observed in mice |

Half-Life Determination of SABA1.1 and SABA5.1 in Cynomolgous Monkeys

Figure 26:
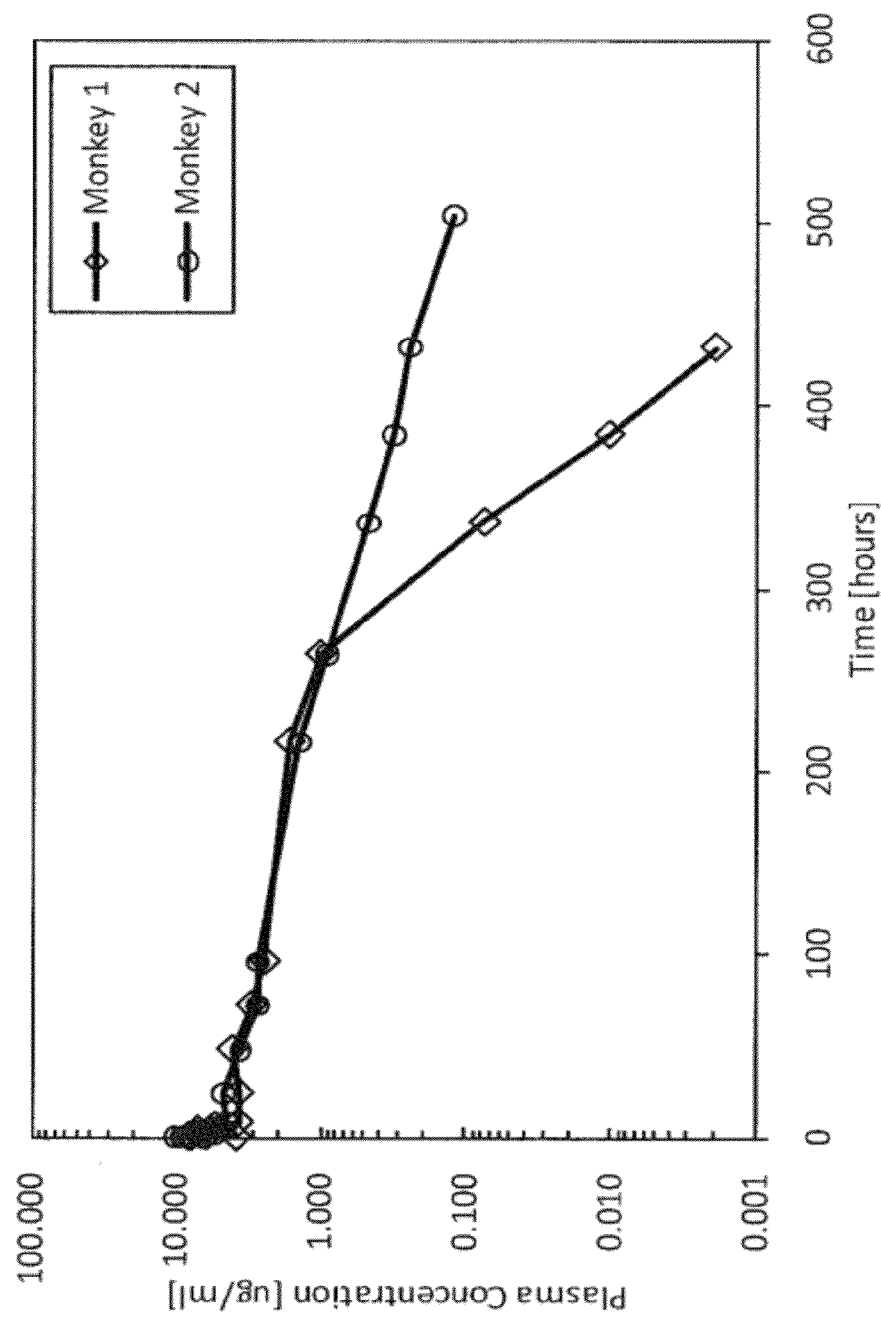
FIG. 26. Half-life determination for SABA1.1 (panel A) and SABA5.1 (panel B) in cynomolgous monkey.
Figure 26:
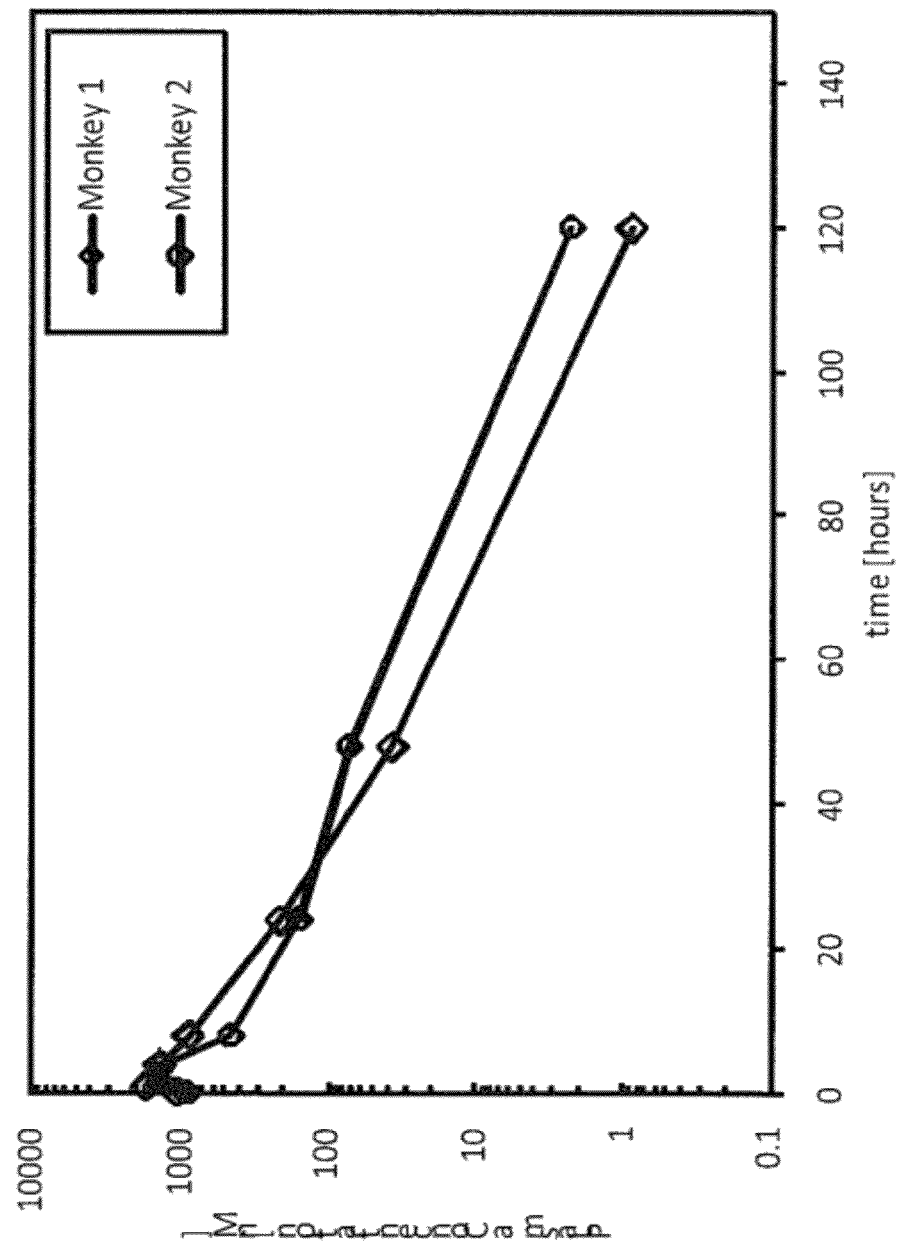

A three week single dose proof of concept study of SABA1.1 (FIG. 26A) and SABA5.1 (FIG. 26B) was conducted in cynomolgus monkeys to assess pharmacokinetics at a 1 mg per kg (mpk) dose IV in 2 cynomolgus monkeys. The pharmacokinetics were evaluated using a quantitative ELISA-based assay that was developed to detect the Adnectin in plasma samples. SABA1.1 has a half-life in the range of 96-137 hours (FIG. 26A and Table 17A). SABA5.1 has a half-life of approximately 12 hours and was only measureable in the ELISA up to 120 hours (FIG. 26B). Table 17A summarizes data for SABA1.1; Table 17B summarizes data for SABA5.1.

TABLE 17A

SABA1.1

| Monkey | t½ (hrs) | Cmax (µg/mL) | AUCall (hr * µg/mL) | Cl_obs (mL/hr/kg) | Vz_obs (mL/kg) |
|---|---|---|---|---|---|
| #1 | 95.8 | 9.03 | 673.7 | 1.45 | 200.8 |
| #2 | 136.6 | 7.24 | 625.1 | 1.60 | 315.2 |

TABLE 17B

SABA5.1

| | HL_Lambda_z (hr) | Cmax (µg/mL) | AUCall (hr * µg/mL) | Cl_obs (mL/hr/kg) | Vz_obs (mL/kg) |
|---|---|---|---|---|---|
| N | 2 | 2 | 2 | 2 | 2 |
| Mean | 12.186 | 17.358 | 246.882 | 4.089 | 72.507 |
| SD | 1.451 | 3.08 | 36.245 | 0.596 | 19.045 |
| Min | 11.16 | 15.18 | 221.25 | 3.67 | 59.04 |
| Max | 13.21 | 19.54 | 272.51 | 4.51 | 85.97 |
| CV % | 11.9 | 17.7 | 14.7 | 14.6 | 26.3 |

Example 5F

Characterization of SABA1 Binding to Serum Albumin

SABA1.1 and 1.2 Binds to HSA and RhSA

Figure 27:
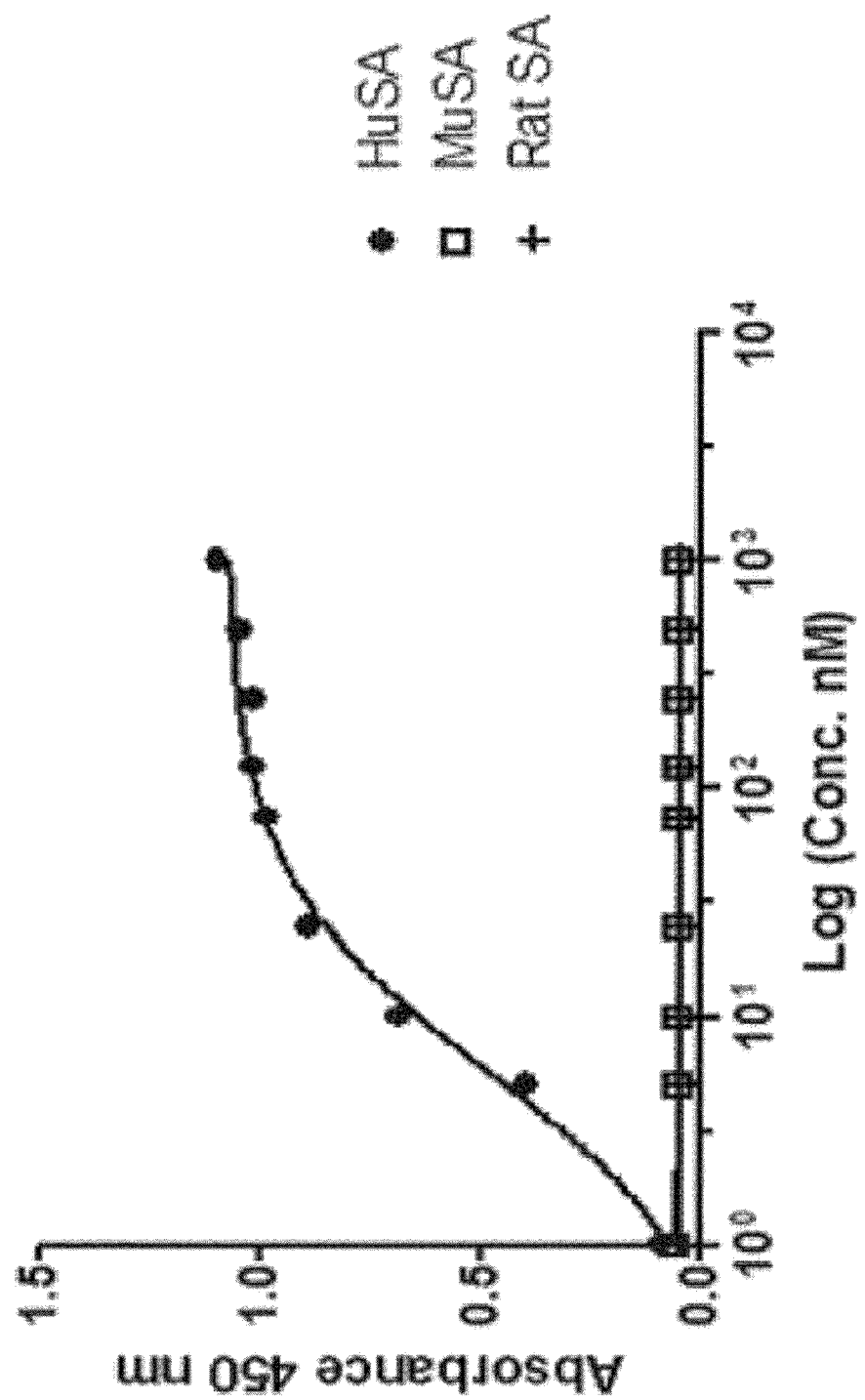
FIG. 27. SABA1.2 binding to albumins from human, mouse and rat by direct binding ELISA assay.

SABA1.2, a "core 1" $^{10}$Fn3 comprising an $(ED)_5$ extension (SEQ ID NO: 421 in Table 6) bound to human serum albumin (HSA) at neutral pH and 25° C. with an average association rate constant (ka) of 8.21E+03 $M^{-1}s^{-1}$, and an average dissociation rate constant (kd) of 4.43E−04 $s^{-1}$, for a calculated average $K_d$ of 55.3 nM (Table 18). For rhesus serum albumin (RhSA), the measured average association rate constant was 6.6E+03 $M^{-1}s^{-1}$, and the dissociation rate constant was 3.78E−03 $s^{-1}$, giving a calculated average $K_d$ of 580 nM. No measurable interaction between SABA1.2 and mouse or rat serum albumin could be observed up to 1 µM (Table 18 and FIG. 27). At 37° C., the ka and kd increased between 2 to 5-fold, leading to a ~2-fold increase in affinity for HSA and ½ the affinity for RhSA (Table 18).

TABLE 18

Kinetic parameters for SABA1.2 binding to albumins, in HBS-P buffer.

| Albumin | Temp (°C.) | ka (1/Ms) | kd (1/s) | KD (nM) |
|---|---|---|---|---|
| Human | 25 | 8.21 ± 1.19E+03 | 4.43 ± 0.65E−04 | 55.3 ± 13.7 |
| Rhesus |  | 6.60 ± 1.18E+03 | 3.78 ± 0.45E−03 | 580 ± 62.6 |
| Mouse |  | no observable binding |  |  |
| Human | 37 | 3.38E+04 | 8.15E−04 | 24.1 |
| Rhesus |  | 1.89E+04 | 1.85E−02 | 977.4 |
| Mouse |  | no observable binding |  |  |

Figure 28:
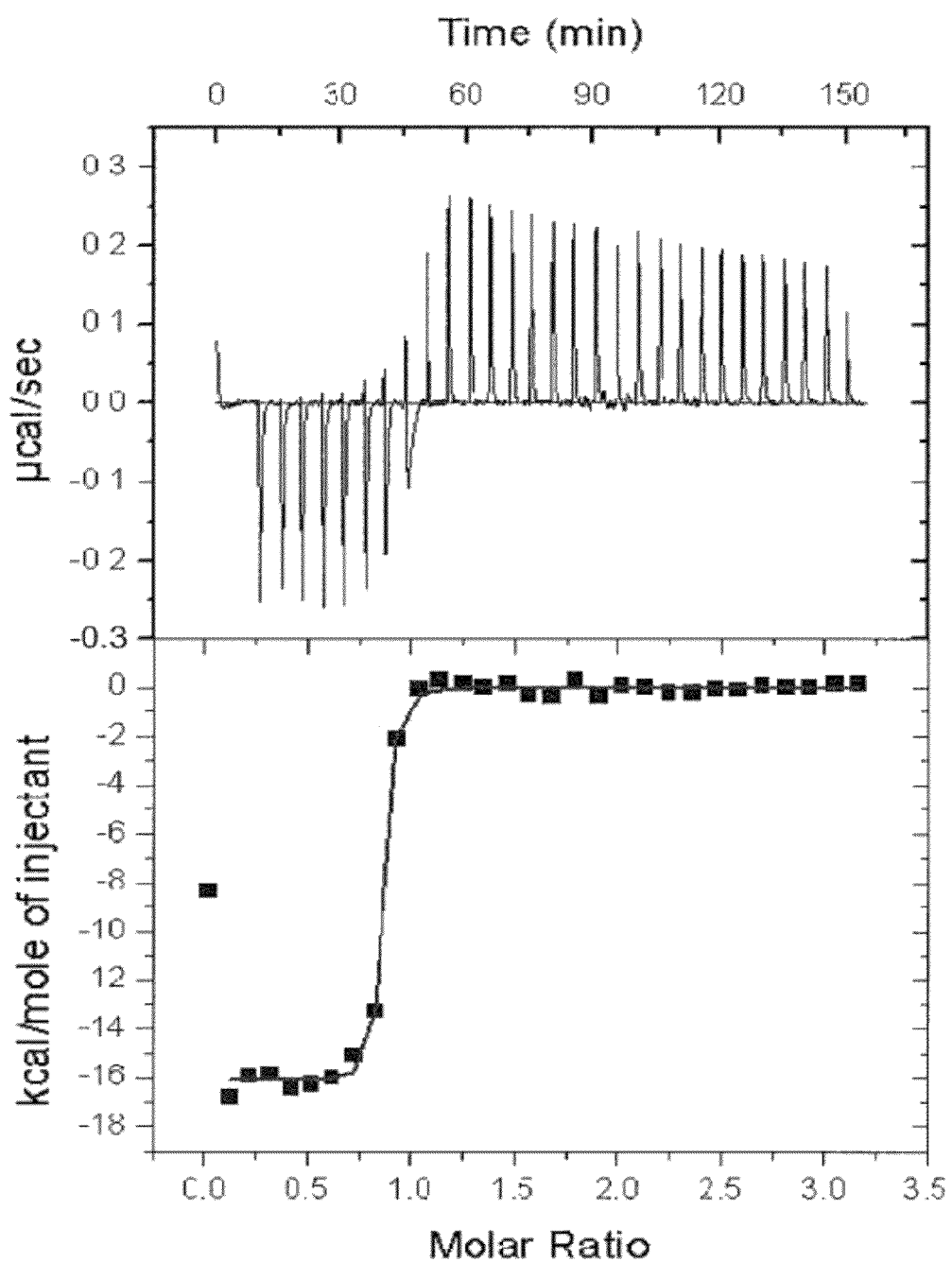
FIG. 28. Determination of SABA1.1 and HSA stoichiometry. SABA1.1 and HSA bind with a stoichiometry of 1:1.

Additionally, a calorimetric titration was performed to determine the stoichiometry between SABA1 and HSA. For this study, SABA1.1, a "core 1" $^{10}$Fn3 comprising a His6 extension (SEQ ID NO: 420 in Table 6), was used. HSA (10 μl per injection of 115 μM protein solution) was injected into the calorimetric cell containing SABA1.1 at a concentration of 8.1 μM. The experiment was performed at 37° C. in PBS buffer pH 7.4. FIG. 28 shows that SABA1.1 binds to HSA with 1:1 stoichiometry.

SABA1.2 Binds Potently to HSA at Low pH

The long half-life of albumins (e.g., $t_{1/2}$ of HSA is 19 days) is due in large part to the fact that they are recycled from an endocytic pathway by binding to the neonatal Fc receptor, FcRn, under the low pH conditions that exist inside the endosome. As shown in Table 19 SABA1.2 potently bound HSA at the endosomal pH of 5.5, suggesting that the $t_{1/2}$ of SABA1, once bound to HSA, would also benefit from the FcRn recycling mechanism.

TABLE 19

Comparison of Albumin Binding Kinetics at pH 7.4 and 5.5, in MES Buffer

| albumin | pH | ka (1/Ms) | kd (1/s) | KD (nM) |
|---|---|---|---|---|
| Human | 7.4 | 9.26E+03 | 3.88E−04 | 41.9 |
|  | 5.5 | 9.44E+03 | 2.70E−04 | 28.6 |
| Rhesus | 7.4 | 6.16E+03 | 2.95E−03 | 479 |
|  | 5.5 | 7.57E+03 | 2.72E−03 | 359 |

SABA1.2 Binds to Domains I and II of HSA, but not Domain III

Figure 29:
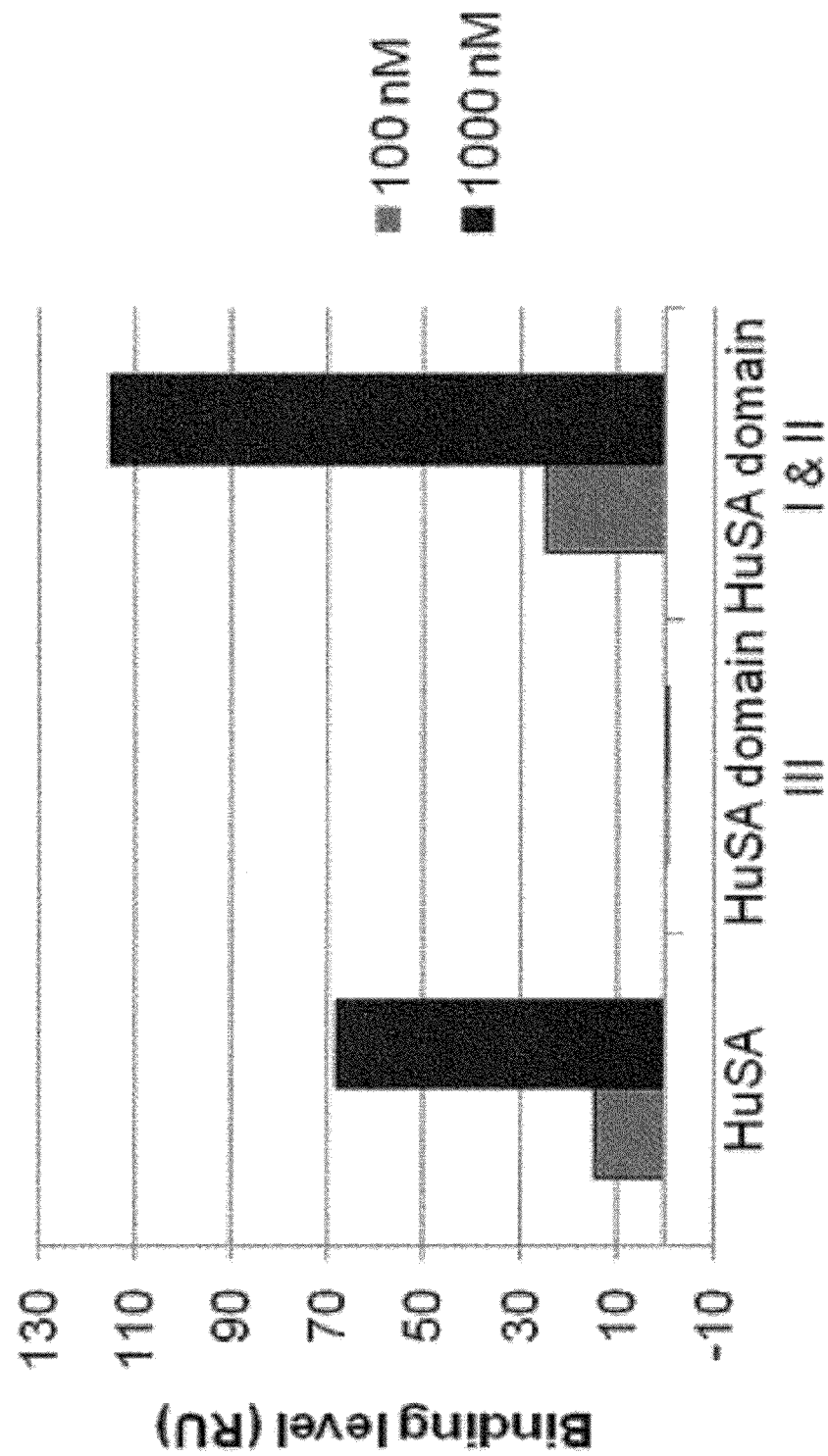
FIG. 29. BIACORE® analysis of SABA1.2 binding to recombinant domain fragments of HSA.

The binding site SABA1.2 on albumin was mapped to the N-terminal domains I or II using recombinant HSA fragments and has no detectable binding to domain III (FIG. 29). Because domain III is the domain of HSA that primarily interacts with FcRn, it is less likely that SABA1.2 would compete for HSA binding to FcRn, again increasing the possibility of fully leveraging the recycling mechanism for enhanced half-life.

Example 5G

In Vivo Pharmacology of SABA1.2

A four week single dose pre-toxicology study of SABA1.2 was conducted in cynomolgus monkeys to assess pharmacokinetics and immunogenicity at two different dose levels. The pharmacokinetics and immunogenicity were also evaluated in a three-week, single-dose pre-toxicology study that included both intravenous and subcutaneous administration arms. Additionally, the pharmacokinetics of SABA1.2 was evaluated in two separate, single dose pre-toxicology studies in cynomolgus monkeys using a quantitative ELISA-based assay that was developed to detect SABA1.2 in plasma samples.

Figure 30:
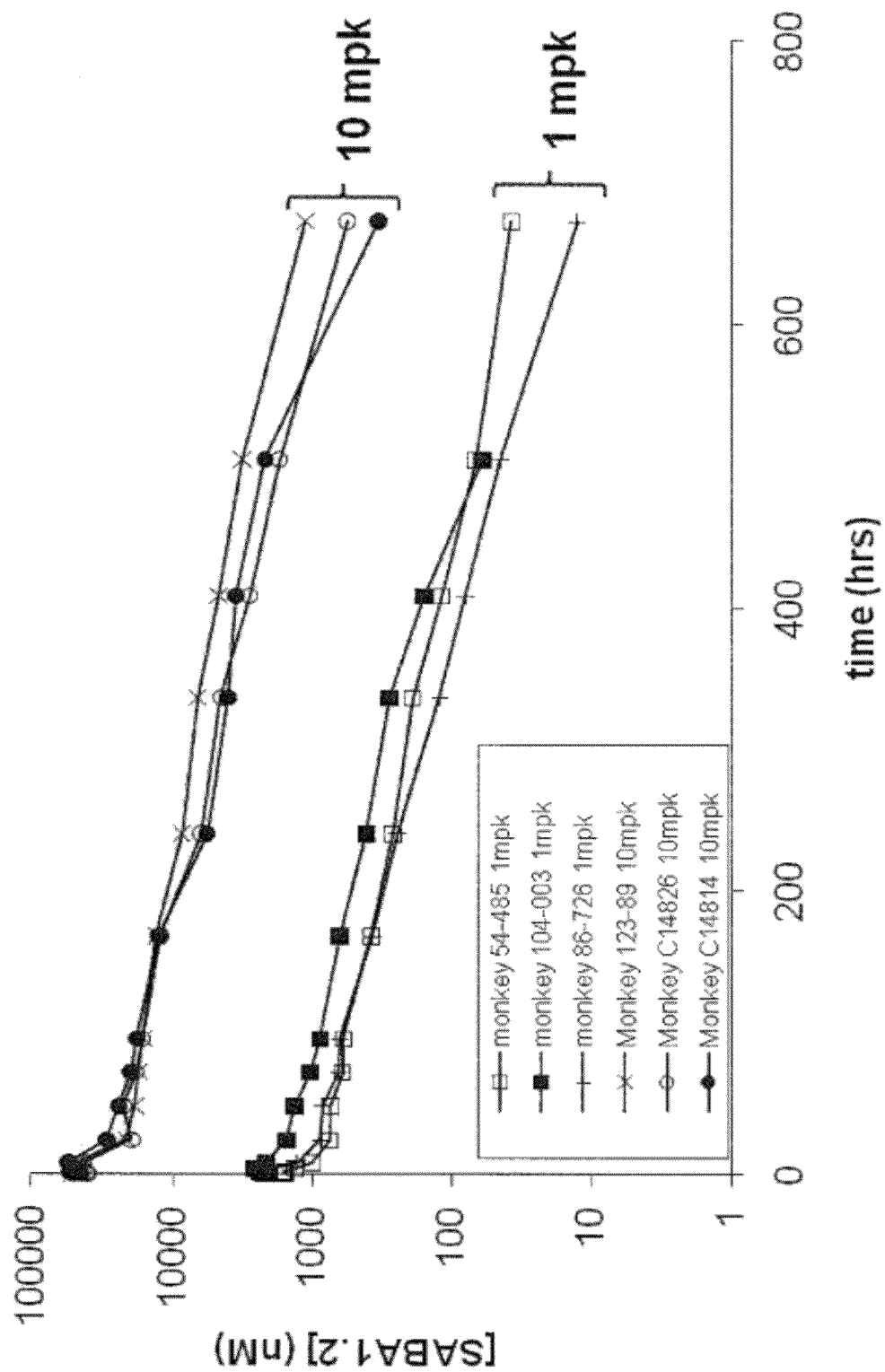
FIG. 30. Pharmacokinetic profile for SABA1.2 in cynomolgus monkeys dosed at 1 mpk and 10 mpk.

SABA1.2 was administered to monkeys at 1 mpk and 10 mpk IV. Non-compartmental analyses using WINNONLIN® software were performed to evaluate pharmacokinetic parameters. As shown in FIG. 30 and the parameters described below, SABA1.2 exhibited dose-dependent pharmacokinetics in this study as determined by area under the concentration-time curve (AUC) evaluation. The clearance (CL) for SABA1.2 at 10 mpk was 0.15 ml/hr/kg, the beta phase half-life ($t_{1/2}$) was 143 hours, the volume of distribution (Vz) was 30 mL/kg, and total drug exposure (AUCall) was 5,609,457 hr*nmol/L (Table 20). The clearance (CL) for SABA1.2 at 1 mpk was 0.4 ml/hr/kg, the half-life ($t_{1/2}$) was 124 hours, the volume of distribution (Vz) was 72 mL/kg, and total drug exposure (AUCall) was 214,636 hr*nmol/L (Table 20).

Figure 31:
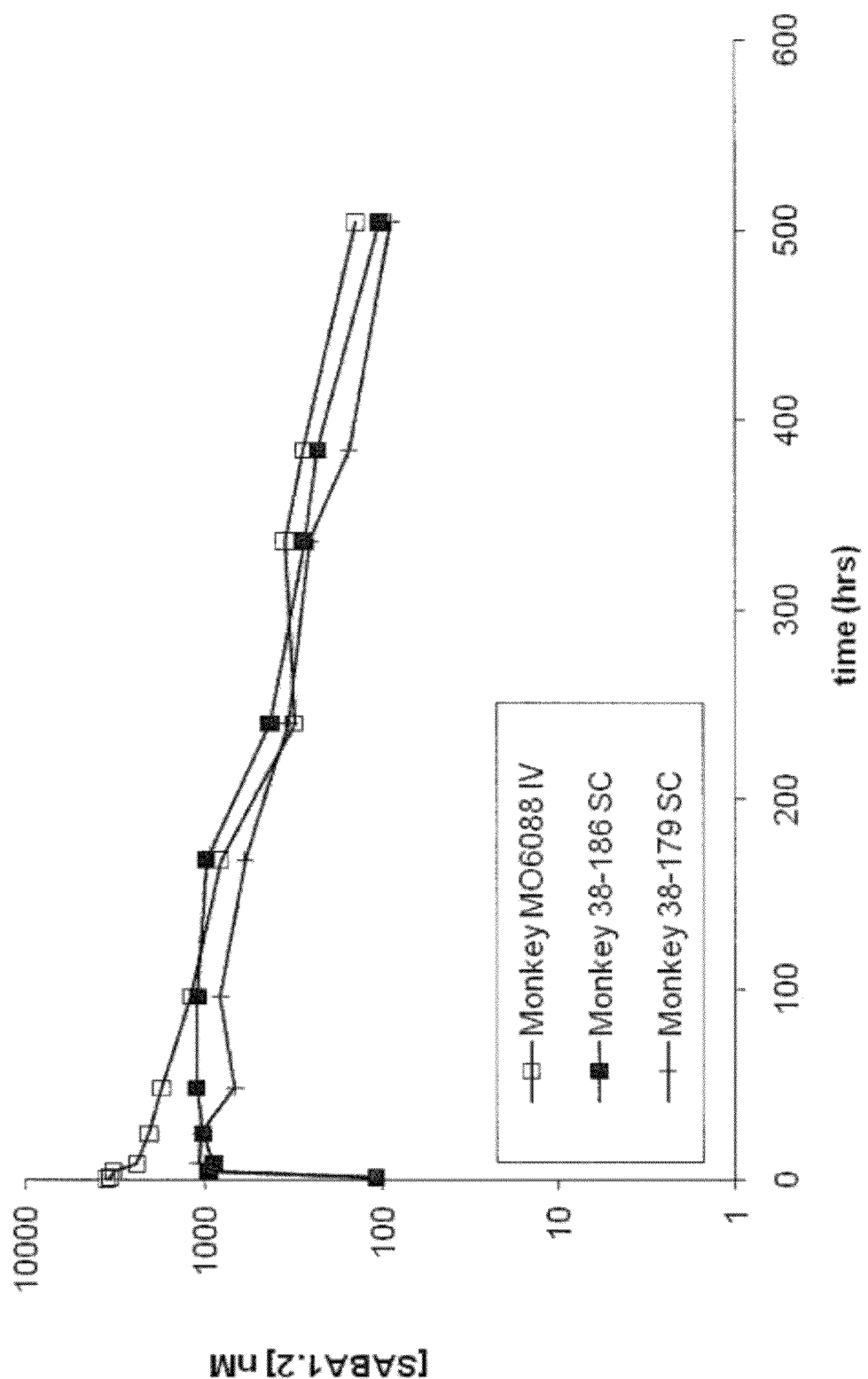
FIG. 31. Pharmacokinetic profile for SABA1.2 in monkeys dosed intravenously or subcutaneously at 1 mpk.

After SC or IV administration of SABA1.2, the beta-phase pharmacokinetic profiles were similar (FIG. 31). The clearance (CL) for SABA1.2 at 1 mpk IV was 0.22 ml/hr/kg, the beta phase half-life ($t_{1/2}$) was 125 hours, the volume of distribution (Vz) was 40 mL/kg, and total drug exposure (AUCall) was 357,993 hr*nmol/L (Table 20). The clearance (CL) for SABA1.2 at 1 mpk SC was 0.32 ml/hr/kg, the beta phase half-life ($t_{1/2}$) was 134 hours, the volume of distribution (Vz) was 62 mL/kg, and total drug exposure (AUCall) was 251,339 hr*nmol/L (Table 20). The SC relative bioavailability (F) compared to IV was 0.7.

TABLE 20

Pharmacokinetic Parameters for SABA1.2 in Monkeys

| | Study # | | | |
|---|---|---|---|---|
| | 1 | | 2 | |
| Dose (mg/kg) | 1 | 10 | 1 | 1 |
| Route of administration | i.v. | i.v. | i.v. | s.c. |
| N | 3 | 3 | 1 | 2 |
| CL (mL/hr/kg) | 0.4 | 0.15 | 0.22 | 0.32 |
| Vz (mL/kg) | 72 | 30 | 40 | 62 |
| AUCall (hr * nmol/L) | 214,636 | 5,609,457 | 357,993 | 251,339 |
| beta $T_{1/2}$ (h) | 124 | 143 | 125 | 134 |
| Bioavailability (F) | n/a | n/a | n/a | 0.7 |

SEQUENCE LISTING (643 sequences)

SEQ ID NO: 1 - protein, 94 aa, Homo sapiens
VSDVPRDLEVVAATPTSLLISWDAPAVTVRYYRITYGETGGNSPVQEFTVPGSKSTATISGLKPGVDYTITVYAVTGRGDSPASSKPISINYRT

SEQ ID NO: 2 - protein, 10 aa, Artificial Sequence
  source: /note="Description of Artificial Sequence: Synthetic peptide"
SWPPPSHGYG

SEQ ID NO: 3 - protein, 10 aa, Artificial Sequence
  source: /note="Description of Artificial Sequence: Synthetic peptide"
SWRPPIHAYG

SEQ ID NO: 4 - protein, 10 aa, Artificial Sequence
  source: /note="Description of Artificial Sequence: Synthetic peptide"
SWDAPIHAYG

SEQ ID NO: 5 - protein, 10 aa, Artificial Sequence
  source: /note="Description of Artificial Sequence: Synthetic peptide"
SWDAPAHAYG

SEQ ID NO: 6 - protein, 10 aa, Artificial Sequence
  source: /note="Description of Artificial Sequence: Synthetic peptide"
SWDAPAVTYG

SEQ ID NO: 7 - protein, 10 aa, Artificial Sequence
  source: /note="Description of Artificial Sequence: Synthetic peptide"
SWSPPANGYG

SEQ ID NO: 8 - protein, 10 aa, Artificial Sequence
  source: /note="Description of Artificial Sequence: Synthetic peptide"
SWTPPPKGYG

SEQ ID NO: 9 - protein, 10 aa, Artificial Sequence
  source: /note="Description of Artificial Sequence: Synthetic peptide"
SWRPPSHAYG

SEQ ID NO: 10 - protein, 10 aa, Artificial Sequence
  source: /note="Description of Artificial Sequence: Synthetic peptide"
SWDPPSHAYG

SEQ ID NO: 11 - protein, 10 aa, Artificial Sequence
  source: /note="Description of Artificial Sequence: Synthetic peptide"
SWEPPSHAYG

SEQ ID NO: 12 - protein, 10 aa, Artificial Sequence
  source: /note="Description of Artificial Sequence: Synthetic peptide"
SWSPPSHAYG

SEQ ID NO: 13 - protein, 10 aa, Artificial Sequence
  source: /note="Description of Artificial Sequence: Synthetic peptide"
SWRPPSNGHG

SEQ ID NO: 14 - protein, 10 aa, Artificial Sequence
  source: /note="Description of Artificial Sequence: Synthetic peptide"
SWVPPSDDYG

SEQ ID NO: 15 - protein, 10 aa, Artificial Sequence
  source: /note="Description of Artificial Sequence: Synthetic peptide"
SWVPSSHAYG

SEQ ID NO: 16 - protein, 10 aa, Artificial Sequence
  source: /note="Description of Artificial Sequence: Synthetic peptide"
SWDPSSHAYG

SEQ ID NO: 17 - protein, 10 aa, Artificial Sequence
  source: /note="Description of Artificial Sequence: Synthetic peptide"
SWEPSSHAYG

SEQ ID NO: 18 - protein, 6 aa, Artificial Sequence
  source: /note="Description of Artificial Sequence: Synthetic peptide"
PPGKGT

SEQ ID NO: 19 - protein, 6 aa, Artificial Sequence
  source: /note="Description of Artificial Sequence: Synthetic peptide"
PIVEGT

SEQ ID NO: 20 - protein, 6 aa, Artificial Sequence
  source: /note="Description of Artificial Sequence: Synthetic peptide"
PGSEGT

SEQ ID NO: 21 - protein, 6 aa, Artificial Sequence
  source: /note="Description of Artificial Sequence: Synthetic peptide"
PGSKGT

SEQ ID NO: 22 - protein, 6 aa, Artificial Sequence
  source: /note="Description of Artificial Sequence: Synthetic peptide"
PGSKST

SEQ ID NO: 23 - protein, 6 aa, Artificial Sequence
  source: /note="Description of Artificial Sequence: Synthetic peptide"
PVGRGT

SEQ ID NO: 24 - protein, 6 aa, Artificial Sequence
  source: /note="Description of Artificial Sequence: Synthetic peptide"
PVGEGT

SEQ ID NO: 25 - protein, 6 aa, Artificial Sequence
  source: /note="Description of Artificial Sequence: Synthetic peptide"
PIGKGT

SEQ ID NO: 26 - protein, 6 aa, Artificial Sequence
  source: /note="Description of Artificial Sequence: Synthetic peptide"
PVNEGT

SEQ ID NO: 27 - protein, 6 aa, Artificial Sequence
  source: /note="Description of Artificial Sequence: Synthetic peptide"
PVGVGT

SEQ ID NO: 28 - protein, 13 aa, Artificial Sequence
  source: /note="Description of Artificial Sequence: Synthetic peptide"
EYPYKHSGYYHRP

SEQ ID NO: 29 - protein, 13 aa, Artificial Sequence
  source: /note="Description of Artificial Sequence: Synthetic peptide"
EYTFKHSGYYHRP

SEQ ID NO: 30 - protein, 13 aa, Artificial Sequence
  source: /note="Description of Artificial Sequence: Synthetic peptide"
EYTYKGSGYYHRP

SEQ ID NO: 31 - protein, 13 aa, Artificial Sequence
  source: /note="Description of Artificial Sequence: Synthetic peptide"
EYTYNGAGYYHRP

SEQ ID NO: 32 - protein, 13 aa, Artificial Sequence
  source: /note="Description of Artificial Sequence: Synthetic peptide"
EYTYIGAGYYHRP

SEQ ID NO: 33 - protein, 13 aa, Artificial Sequence
  source: /note="Description of Artificial Sequence: Synthetic peptide"
EYTYEGAGYYHRP

SEQ ID NO: 34 - protein, 13 aa, Artificial Sequence
  source: /note="Description of Artificial Sequence: Synthetic peptide"
EYAYNGAGYYHRP

SEQ ID NO: 35 - protein, 13 aa, Artificial Sequence
  source: /note="Description of Artificial Sequence: Synthetic peptide"
EYPWKGSGYYHRP

SEQ ID NO: 36 - protein, 13 aa, Artificial Sequence
  source: /note="Description of Artificial Sequence: Synthetic peptide"
EFPFKWSGYYHRP

SEQ ID NO: 37 - protein, 13 aa, Artificial Sequence
  source: /note="Description of Artificial Sequence: Synthetic peptide"
EFPWPHAGYYHRP

SEQ ID NO: 38 - protein, 13 aa, Artificial Sequence
  source: /note="Description of Artificial Sequence: Synthetic peptide"
EYAFEGAGYYHRP

SEQ ID NO: 39 - protein, 110 aa, Artificial Sequence
  source: /note="Description of Artificial Sequence: Synthetic polypeptide"
MGVSDVPRDLEVVAATPTSLLISWPPPSHGYGYYRITYGETGGNSPVQEFTVPPGKGTATISGLKPGVDYTITVYAVEYPYKHSGYYHRPISINYRTEIDKPSQHHHHHH

SEQ ID NO: 40 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggccgccgccgtctcatggttacggttattaccgcatcacttacggcgaaacaggaggcaatagccctgtccaggagttcactgtgccgcctggtaaaggtacagctaccatcagcggccttaaacctggcgttgattataccatcactgtgtatgctgtcgaatacccgtacaaacattctggttactaccatcgtccaatttccattaattaccgcacagaaattgacaaaccatcccagcaccatcaccaccaccac

SEQ ID NO: 41 - protein, 110 aa, Artificial Sequence
  source: /note="Description of Artificial Sequence: Synthetic polypeptide"
MGVSDVPRDLEVVAATPTSLLISWRPPIHAYGYYRITYGETGGNSPVQEFTVPIVEGTATISGLKPGVDYTITVYAVEYTFKHSGYYHRPISINYRTEIDKPSQHHHHHH

SEQ ID NO: 42 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggaggccgccgattcatgcttacgggtattaccgcatcacttacggcgaaacaggaggcaatagccctgtccaggagttcactgtgcctattgttgaaggtacagctaccatcagcggccttaaacctggcgttgattataccatcactgtgtatgctgtcgaatatacatttaaacattccggttactaccatcgtccaatttccattaattaccgcacagaaattgacaaaccatcccagcaccatcaccaccaccac

SEQ ID NO: 43 - protein, 110 aa, Artificial Sequence
  source: /note="Description of Artificial Sequence: Synthetic polypeptide"
MGVSDVPRDLEVVAATPTSLLISWDAPIHAYGYYRITYGETGGNSPVQEFTVPGSEGTATISGLKPGVDYTITVYAVEYTFKHSGYYHRPISINYRTEIDKPSQHHHHHH

SEQ ID NO: 44 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccgattcatgcttacgggtattaccgcatcacttacggcgaaacaggaggcaatagccctgtccaggagttcactgtgcctggttctgaaggtacagctaccatcagcggccttaaacctggcgttgattataccatcactgtgtatgctgtcgaatatacatttaaacattccggttactaccatcgtccaatttccattaattaccgcacagaaattgacaaaccatcccagcaccatcaccaccaccac

SEQ ID NO: 45 - protein, 110 aa, Artificial Sequence
  source: /note="Description of Artificial Sequence: Synthetic polypeptide"
MGVSDVPRDLEVVAATPTSLLISWDAPAHAYGYYRITYGETGGNSPVQEFTVPGSKGTATISGLKPGVDYTITVYAVEYTFKHSGYYHRPISINYRTEIDKPSQHHHHHH

SEQ ID NO: 46 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctcatgcttacgggtattaccgcatcacttacggcgaaacaggaggcaatagccctgtccaggagttcactgtgcctggttctaaaggtacagctaccatcagcggccttaaacctggcgttgattataccatcactgtgtatgctgtcgaatatacatttaaacattccggttactaccatcgtccaatttccattaattaccgcacagaaattgacaaaccatcccagcaccatcaccaccaccac

SEQ ID NO: 47 - protein, 110 aa, Artificial Sequence
  source: /note="Description of Artificial Sequence: Synthetic polypeptide"
MGVSDVPRDLEVVAATPTSLLISWDAPAVTYGYYRITYGETGGNSPVQEFTVPGSKSTATISGLKPGVDYTITVYAVEYTFKHSGYYHRPISINYRTEIDKPSQHHHHHH

SEQ ID NO: 48 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgttacttacgggtattaccgcatcacttacggcgaaacaggaggcaatagccctgtccaggagttcactgtgcctggttctaaatctacagctaccatcagcggccttaaacctggcgttgattataccatcactgtgtatgctgtcgaatatacatttaaacattccggttactaccatcgtccaatttccattaattaccgcacagaaattgacaaaccatcccagcaccatcaccaccaccac

SEQ ID NO: 49 - protein, 110 aa, Artificial Sequence
  source: /note="Description of Artificial Sequence: Synthetic polypeptide"
MGVSDVPRDLEVVAATPTSLLISWSPPANGYGYYRITYGETGGNSPVQEFTVPVGRGTATISGLKPGVDYTITVYAVEYTYKGSGYYHRPISINYRTEIDKPSQHHHHHH

SEQ ID NO: 50 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggtccccaccggctaacggttacggttattaccgcatcacttacggcgaaacaggaggcaatagccctgtccaggagttcactgtgcctgttggtagaggtacagctaccatcagcggccttaaacctggcgttgattataccatcactgtgtatgctgtcgagtatacctacaaaggctctggttactaccatcgcccaatttccattaattaccgcacagaaattgacaaaccatcccagcaccatcaccaccaccac

SEQ ID NO: 51 - protein, 110 aa, Artificial Sequence
  source: /note="Description of Artificial Sequence: Synthetic polypeptide"
MGVSDVPRDLEVVAATPTSLLISWTPPPKGYGYYRITYGETGGNSPVQEFTVPVGEGTATISGLKPGVDYTITVYAVEYTYNGAGYYHRPISINYRTEIDKPSQHHHHHH

SEQ ID NO: 52 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggacgcctccccctaaagggtatggttattaccgcatcacttacggcgaaacaggaggcaatagccctgtccaggagttcactgtgcctgttggtgaaggtacagctaccatcagcggccttaaacctggcgttgattataccatcactgtgtatgctgtcgaatacacgtacaacggtgccggttactaccaccggccaatttccattaattaccgcacagaaattgacaaaccatcccagcaccatcaccaccaccac

SEQ ID NO: 53 - protein, 107 aa, Artificial Sequence
  source: /note="Description of Artificial Sequence: Synthetic polypeptide"
MGVSDVPRDLEVVAATPTSLLISWTPPPKGYGYYRITYGETGGNSPVQEFTVPVGEGTATISGLKPGVDYTITVYAVEYTYIGAGYYHRPISINYRTGSGSHHHHHH

SEQ ID NO: 54 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggacgcctccccctaaagggtatggttattaccgcatcacttacggcgaaacaggaggcaatagccctgtccaggagttcactgtgcctgttggtgaaggtacagctaccatcagcggccttaaacctggcgttgattataccatcactgtgtatgctgtcgaatacacgtacattggtgccggttactaccaccggccaatttccattaattaccgcacaggtagcggttcccaccatcaccaccatcac

SEQ ID NO: 55 - protein, 107 aa, Artificial Sequence
  source: /note="Description of Artificial Sequence: Synthetic polypeptide"
MGVSDVPRDLEVVAATPTSLLISWTPPPKGYGYYRITYGETGGNSPVQEFTVPVGEGTATISGLKPGVDYTITVYAVEYTYEGAGYYHRPISINYRTGSGSHHHHHH

SEQ ID NO: 56 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggacgcctccccctaaagggtatggttattaccgcatcacttacggcgaaacaggaggcaatagccctgtccaggagttcactgtgcctgttggtgaaggtacagctaccatcagcggccttaaacctggcgttgattataccatcactgtgtatgctgtcgaatacacgtacgaaggtgccggttactaccaccggccaatttccattaattaccgcacaggtagcggttcccaccatcaccaccatcac

SEQ ID NO: 57 - protein, 107 aa, Artificial Sequence
  source: /note="Description of Artificial Sequence: Synthetic polypeptide"
MGVSDVPRDLEVVAATPTSLLISWTPPPKGYGYYRITYGETGGNSPVQEFTVPVGEGTATISGLKPGVDYTITVYAVEYAYNGAGYYHRPISINYRTGSGSHHHHHH

SEQ ID NO: 58 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggacgcctccccctaaagggtatggttattaccgcatcacttacggcgaaacaggaggcaatagccctgtccaggagttcactgtgcctgttggtgaaggtacagctaccatcagcggccttaaacctggcgttgattataccatcactgtgtatgctgtcgaatacgcgtacaacggtgccggttactaccaccggccaatttccattaattaccgcacaggtagcggttcccaccatcaccaccatcac

SEQ ID NO: 59 - protein, 110 aa, Artificial Sequence
  source: /note="Description of Artificial Sequence: Synthetic polypeptide"
MGVSDVPRDLEVVAATPTSLLISWRPPSHAYGYYRITYGETGGNSPVQEFTVPIGKGTATISGLKPGVDYTITVYAVEYPWKGSGYYHRPISINYRTEIDKPSQHHHHHH

SEQ ID NO: 60 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggcggccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacagaaattgacaaaccatcccagcaccatcaccaccaccac

SEQ ID NO: 61 - protein, 107 aa, Artificial Sequence
  source: /note="Description of Artificial Sequence: Synthetic polypeptide"
MGVSDVPRDLEVVAATPTSLLISWDPPSHAYGYYRITYGETGGNSPVQEFTVPIGKGTATISGLKPGVDYTITVYAVEYPWKGSGYYHRPISINYRTGSGSHHHHHH

SEQ ID NO: 62 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacaggtagcggttcccaccatcaccaccatcac

SEQ ID NO: 63 - protein, 107 aa, Artificial Sequence
  source: /note="Description of Artificial Sequence: Synthetic polypeptide"
MGVSDVPRDLEVVAATPTSLLISWEPPSHAYGYYRITYGETGGNSPVQEFTVPIGKGTATISGLKPGVDYTITVYAVEYPWKGSGYYHRPISINYRTGSGSHHHHHH

SEQ ID NO: 64 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggaaccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacaggtagcggttcccaccatcaccaccatcac

SEQ ID NO: 65 - protein, 107 aa, Artificial Sequence
  source: /note="Description of Artificial Sequence: Synthetic polypeptide"
MGVSDVPRDLEVVAATPTSLLISWSPPSHAYGYYRITYGETGGNSPVQEFTVPIGKGTATISGLKPGVDYTITVYAVEYPWKGSGYYHRPISINYRTGSGSHHHHHH

SEQ ID NO: 66 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggagcccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacaggtagcggttcccaccatcaccaccatcac

SEQ ID NO: 67 - protein, 110 aa, Artificial Sequence
  source: /note="Description of Artificial Sequence: Synthetic polypeptide"
MGVSDVPRDLEVVAATPTSLLISWRPPSNGHGYYRITYGETGGNSPVQEFTVPVNEGTATISGLKPGVDYTITVYAVEFPFKWSGYYHRPISINYRTEIDKPSQHHHHHH

SEQ ID NO: 68 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggcggcccccctctaatggtcacggttattaccgcatcacttacggcgaaacaggaggcaatagccctgtccaggagttcactgtgcctgttaatgaaggtacagctaccatcagcggccttaaacctggcgttgattataccatcactgtgtatgctgtcgaattccccttcaagtggtcgggctactaccatcgaccaatttccattaattaccgcacagaaattgacaaaccatcccagcaccatcaccaccaccac

SEQ ID NO: 69 - protein, 110 aa, Artificial Sequence
  source: /note="Description of Artificial Sequence: Synthetic polypeptide"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTEIDKPSQHHHHHH

SEQ ID NO: 70 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggtcccgccttcagatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgacaaaccatcccagcaccatcaccaccaccac

SEQ ID NO: 71 - protein, 110 aa, Artificial Sequence
  source: /note="Description of Artificial Sequence: Synthetic polypeptide"
MGVSDVPRDLEVVAATPTSLLISWVPSSHAYGYYRITYGETGGNSPVQEFTVPVGVGTATISGLKPGVDYTITVYAVEYAFEGAGYYHRPISINYRTEIDKPSQHHHHHH

SEQ ID NO: 72 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggttccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacagaaattgacaaaccatcccagcaccatcaccaccaccac

SEQ ID NO: 73 - protein, 110 aa, Artificial Sequence
  source: /note="Description of Artificial Sequence: Synthetic polypeptide"
MGVSDVPRDLEVVAATPTSLLISWDPSSHAYGYYRITYGETGGNSPVQEFTVPVGVGTATISGLKPGVDYTITVYAVEYAFEGAGYYHRPISINYRTEIDKPSQHHHHHH

SEQ ID NO: 74 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacagaaattgacaaaccatcccagcaccatcaccaccaccac

SEQ ID NO: 75 - protein, 110 aa, Artificial Sequence
  source: /note="Description of Artificial Sequence: Synthetic polypeptide"
MGVSDVPRDLEVVAATPTSLLISWEPSSHAYGYYRITYGETGGNSPVQEFTVPVGVGTATISGLKPGVDYTITVYAVEYAFEGAGYYHRPISINYRTEIDKPSQHHHHHH

SEQ ID NO: 76 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggaaccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacagaaattgacaaaccatcccagcaccatcaccaccaccac

SEQ ID NO: 77 - protein, 4 aa, Artificial Sequence
  source: /note="Description of Artificial Sequence: Synthetic peptide"
GSGC

SEQ ID NO: 78 - protein, 104 aa, Artificial Sequence
  source: /note="Description of Artificial Sequence: Synthetic polypeptide"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTEIDKPCQ

SEQ ID NO: 79 - DNA, 314 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggtcccgccttcagatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgacaaaccatgccagtg

SEQ ID NO: 80 - protein, 102 aa, Artificial Sequence
  source: /note="Description of Artificial Sequence: Synthetic polypeptide"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTEGSGC

SEQ ID NO: 81 - DNA, 308 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggtcccgccttcagatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgaacagaaggtagcggttgctg

SEQ ID NO: 82 - protein, 104 aa, Artificial Sequence
  source: /note="Description of Artificial Sequence: Synthetic polypeptide"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTEIEKPCQ

SEQ ID NO: 83 - DNA, 314 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggtcccgccttcagatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgagaaaccatgccagtg

SEQ ID NO: 84 - protein, 107 aa, Artificial Sequence
  source: /note="Description of Artificial Sequence: Synthetic polypeptide"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTGSGCHHHHHH

SEQ ID NO: 85 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggtcccgccttcagatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacaggtagcggttgccaccatcaccaccatcac

SEQ ID NO: 86 - protein, 110 aa, Artificial Sequence
  source: /note="Description of Artificial Sequence: Synthetic polypeptide"
MGVSDVPRDLEVVAATPTSLLISWPPPSHGYGYYRITYGETGGNSPVQEFTVPPGKGTATISGLKPGVDYTITVYAVEYPYKHSGYYHRPISINYRTEIDKPCQHHHHHH

SEQ ID NO: 87 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggccgccgccgtctcatggttacggttattaccgcatcacttacggcgaaacaggaggcaatagccctgtccaggagttcactgtgccgcctggtaaaggtacagctaccatcagcggccttaaacctggcgttgattataccatcactgtgtatgctgtcgaatacccgtacaaacattctggttactaccatcgtccaatttccattaattaccgcacagaaattgacaaaccatgccagcaccatcaccaccaccac

SEQ ID NO: 88 - protein, 110 aa, Artificial Sequence
  source: /note="Description of Artificial Sequence: Synthetic polypeptide"
MGVSDVPRDLEVVAATPTSLLISWRPPIHAYGYYRITYGETGGNSPVQEFTVPIVEGTATISGLKPGVDYTITVYAVEYTFKHSGYYHRPISINYRTEIDKPCQHHHHHH

SEQ ID NO: 89 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggaggccgccgattcatgcttacgggtattaccgcatcacttacggcgaaacaggaggcaatagccctgtccaggagttcactgtgcctattgttgaaggtacagctaccatcagcggccttaaacctggcgttgattataccatcactgtgtatgctgtcgaatatacatttaaacattccggttactaccatcgtccaatttccattaattaccgcacagaaattgacaaaccatgccagcaccatcaccaccaccac

SEQ ID NO: 90 - protein, 107 aa, Artificial Sequence
  source: /note="Description of Artificial Sequence: Synthetic polypeptide"
MGVSDVPRDLEVVAATPTSLLISWRPPSNGHGYYRITYGETGGNSPVQEFTVPVNEGTATISGLKPGVDYTITVYAVEFPFKWSGYYHRPISINYRTGSGCHHHHHH

SEQ ID NO: 91 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggcggcccccctctaatggtcacggttattaccgcatcacttacggcgaaacaggaggcaatagccctgtccaggagttcactgtgcctgttaatgaaggtacagctaccatcagcggccttaaacctggcgttgattataccatcactgtgtatgctgtcgaattccccttcaagtggtcgggctactaccatcgaccaatttccattaattaccgcacaggtagcggttgccaccatcaccaccatcac

SEQ ID NO: 92 - protein, 107 aa, Artificial Sequence
  source: /note="Description of Artificial Sequence: Synthetic polypeptide"
MGVSDVPRDLEVVAATPTSLLISWVPSSHAYGYYRITYGETGGNSPVQEFTVPVGVGTATISGLKPGVDYTITVYAVEYAFEGAGYYHRPISINYRTGSGCHHHHHH

SEQ ID NO: 93 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggttccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacaggtagcggttgccaccatcaccaccatcac

SEQ ID NO: 94 - protein, 108 aa, Artificial Sequence
  source: /note="Description of Artificial Sequence: Synthetic polypeptide"
MGVSDVPRDLEVVAATPTSLLISWDPSSHAYGYYRITYGETGGNSPVQEFTVPVGVGTATISGLKPGVDYTITVYAVEYAFEGAGYYHRPISINYRTEGSGCHHHHHH

SEQ ID NO: 95 - DNA, 324 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacagaaggtagcggttgccaccatcaccaccatcac

SEQ ID NO: 96 - protein, 108 aa, Artificial Sequence
  source: /note="Description of Artificial Sequence: Synthetic polypeptide"
MGVSDVPRDLEVVAATPTSLLISWEPSSHAYGYYRITYGETGGNSPVQEFTVPVGVGTATISGLKPGVDYTITVYAVEYAFEGAGYYHRPISINYRTEGSGCHHHHHH

SEQ ID NO: 97 - DNA, 324 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggaaccgtcgtctcatgcctacggttattaccgcatcacttacggcgaaacaggaggcaatagccctgtccaggagttcactgtgcctgtgggggtaggtacagctaccatcagcggccttaaacctggcgttgattataccatcactgtgtatgctgtcgaatacgctttcgaaggggctggttactaccatcgtccaatttccattaattaccgcacagaaggtagcggttgccaccatcaccaccatcac

SEQ ID NO: 98 - protein, 107 aa, Artificial Sequence
  source: /note="Description of Artificial Sequence: Synthetic polypeptide"
MGVSDVPRDLEVVAATPTSLLISWTPPPKGYGYYRITYGETGGNSPVQEFTVPVGEGTATISGLKPGVDYTITVYAVEYTYNGAGYYHRPISINYRTGSGCHHHHHH

SEQ ID NO: 99 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggacgcctccccctaaagggtatggttattaccgcatcacttacggcgaaacaggaggcaatagccctgtccaggagttcactgtgcctgttggtgaaggtacagctaccatcagcggccttaaacctggcgttgattataccatcactgtgtatgctgtcgaatacacgtacaacggtgccggttactaccaccggccaatttccattaattaccgcacaggtagcggttgccaccatcaccaccatcac

SEQ ID NO: 100 - protein, 107 aa, Artificial Sequence
  source: /note="Description of Artificial Sequence: Synthetic polypeptide"
MGVSDVPRDLEVVAATPTSLLISWRPPSHAYGYYRITYGETGGNSPVQEFTVPIGKGTATISGLKPGVDYTITVYAVEYPWKGSGYYHRPISINYRTGSGCHHHHHH

SEQ ID NO: 101 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggcggccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacaggtagcggttgccaccatcaccaccatcac

SEQ ID NO: 102 - protein, 110 aa, Artificial Sequence
  source: /note="Description of Artificial Sequence: Synthetic polypeptide"
MGVSDVPRDLEVVAATPTSLLISWRPPSHAYGYYRITYGETGGNSPVQEFTVPIGKGTATISGLKPGVDYTITVYAVEYPWKGSGYYHRPISINYRTEIDKPCQHHHHHH

SEQ ID NO: 103 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggcggccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacagaaattgacaaaccatgccagcaccaccaccaccaccac

SEQ ID NO: 104 - protein, 108 aa, Artificial Sequence
  source: /note="Description of Artificial Sequence: Synthetic polypeptide"
MGVSDVPRDLEVVAATPTSLLISWEPPSHAYGYYRITYGETGGNSPVQEFTVPIGKGTATISGLKPGVDYTITVYAVEYPWKGSGYYHRPISINYRTEGSGCHHHHHH

SEQ ID NO: 105 - DNA, 324 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggaaccgccatctcatgcttatggttattaccgcatcacttacggcgaaacaggaggcaatagccctgtccaggagttcactgtgcctattgggaaaggtacagctaccatcagcggccttaaacctggcgttgattataccatcactgtgtatgctgtcgaatacccgtggaaaggttctggttactaccatcggccaatttccattaattaccgcacagaaggtagcggttgccaccatcaccaccatcac

SEQ ID NO: 106 - protein, 13 aa, Artificial Sequence
  source: /note="Description of Artificial Sequence: Synthetic peptide"
SWEPFSRLPGGGE

SEQ ID NO: 107 - protein, 11 aa, Artificial Sequence
  source: /note="Description of Artificial Sequence: Synthetic peptide"
SWDAPADGGYG

SEQ ID NO: 108 - protein, 11 aa, Artificial Sequence
  source: /note="Description of Artificial Sequence: Synthetic peptide"
SWDAPAGDGYG

SEQ ID NO: 109 - protein, 11 aa, Artificial Sequence
  source: /note="Description of Artificial Sequence: Synthetic peptide"
SWAAPAGGGYG

SEQ ID NO: 110 - protein, 10 aa, Artificial Sequence
  source: /note="Description of Artificial Sequence: Synthetic peptide"
SWDAPADAYG

SEQ ID NO: 111 - protein, 11 aa, Artificial Sequence
  source: /note="Description of Artificial Sequence: Synthetic peptide"
SWDAPADGAYG

SEQ ID NO: 112 - protein, 10 aa, Artificial Sequence
  source: /note="Description of Artificial Sequence: Synthetic peptide"
SWDAPAEGYG

SEQ ID NO: 113 - protein, 11 aa, Artificial Sequence
  source: /note="Description of Artificial Sequence: Synthetic peptide"
SWDAPADEAYG

SEQ ID NO: 114 - protein, 10 aa, Artificial Sequence
  source: /note="Description of Artificial Sequence: Synthetic peptide"
SWDAPADGYG

SEQ ID NO: 115 - protein, 11 aa, Artificial Sequence
  source: /note="Description of Artificial Sequence: Synthetic peptide"
SWDAPAGGGYG

SEQ ID NO: 116 - protein, 11 aa, Artificial Sequence
  source: /note="Description of Artificial Sequence: Synthetic peptide"
SWDAPAADAYG

SEQ ID NO: 117 - protein, 13 aa, Artificial Sequence
  source: /note="Description of Artificial Sequence: Synthetic peptide"
SWDAPAEAGKHYG

SEQ ID NO: 118 - protein, 10 aa, Artificial Sequence
  source: /note="Description of Artificial Sequence: Synthetic peptide"
SWDAPAEAYG

SEQ ID NO: 119 - protein, 10 aa, Artificial Sequence
  source: /note="Description of Artificial Sequence: Synthetic peptide"
SWDAPAAAYG

SEQ ID NO: 120 - protein, 10 aa, Artificial Sequence
  source: /note="Description of Artificial Sequence: Synthetic peptide"
SWDAPAGGYG

SEQ ID NO: 121 - protein, 11 aa, Artificial Sequence
  source: /note="Description of Artificial Sequence: Synthetic peptide"
SWDAPAAGGYG

SEQ ID NO: 122 - protein, 10 aa, Artificial Sequence
  source: /note="Description of Artificial Sequence: Synthetic peptide"
SWDAPAAGYG

SEQ ID NO: 123 - protein, 12 aa, Artificial Sequence
  source: /note="Description of Artificial Sequence: Synthetic peptide"
SWDAPAGAASYG

SEQ ID NO: 124 - protein, 10 aa, Artificial Sequence
  source: /note="Description of Artificial Sequence: Synthetic peptide"
SWDAPAGAYG

SEQ ID NO: 125 - protein, 10 aa, Artificial Sequence
  source: /note="Description of Artificial Sequence: Synthetic peptide"
SWDPPAEGYG

SEQ ID NO: 126 - protein, 10 aa, Artificial Sequence
  source: /note="Description of Artificial Sequence: Synthetic peptide"
SWNPPDVNYG

SEQ ID NO: 127 - protein, 11 aa, Artificial Sequence
  source: /note="Description of Artificial Sequence: Synthetic peptide"
SWDAPAEGGYG

SEQ ID NO: 128 - protein, 13 aa, Artificial Sequence
  source: /note="Description of Artificial Sequence: Synthetic peptide"
SWSEKLDGKARRG

SEQ ID NO: 129 - protein, 14 aa, Artificial Sequence
  source: /note="Description of Artificial Sequence: Synthetic peptide"
SWSPRDSTGLVRRG

SEQ ID NO: 130 - protein, 13 aa, Artificial Sequence
  source: /note="Description of Artificial Sequence: Synthetic peptide"
SWGDVRTNEARQG

SEQ ID NO: 131 - protein, 12 aa, Artificial Sequence
  source: /note="Description of Artificial Sequence: Synthetic peptide"
SWDAPAEAEAYG

SEQ ID NO: 132 - protein, 11 aa, Artificial Sequence
  source: /note="Description of Artificial Sequence: Synthetic peptide"
SWDAPAEGAYG

SEQ ID NO: 133 - protein, 10 aa, Artificial Sequence
  source: /note="Description of Artificial Sequence: Synthetic peptide"
SWQPPAVTYG

SEQ ID NO: 134 - protein, 10 aa, Artificial Sequence
  source: /note="Description of Artificial Sequence: Synthetic peptide"
SWDPPAGAYG

SEQ ID NO: 135 - protein, 10 aa, Artificial Sequence
  source: /note="Description of Artificial Sequence: Synthetic peptide"
SWAPPSDAYG

SEQ ID NO: 136 - protein, 6 aa, Artificial Sequence
  source: /note="Description of Artificial Sequence: Synthetic peptide"
PSSKGT

SEQ ID NO: 137 - protein, 6 aa, Artificial Sequence
  source: /note="Description of Artificial Sequence: Synthetic peptide"
PVSKST

SEQ ID NO: 138 - protein, 6 aa, Artificial Sequence
  source: /note="Description of Artificial Sequence: Synthetic peptide"
PVSKGT

SEQ ID NO: 139 - protein, 6 aa, Artificial Sequence
  source: /note="Description of Artificial Sequence: Synthetic peptide"
PVFKGT

SEQ ID NO: 140 - protein, 6 aa, Artificial Sequence
  source: /note="Description of Artificial Sequence: Synthetic peptide"
PVYKGT

SEQ ID NO: 141 - protein, 6 aa, Artificial Sequence
  source: /note="Description of Artificial Sequence: Synthetic peptide"
PGYKGT

SEQ ID NO: 142 - protein, 13 aa, Artificial Sequence
  source: /note="Description of Artificial Sequence: Synthetic peptide"
EYPYDYSGYYHRP

SEQ ID NO: 143 - protein, 13 aa, Artificial Sequence
  source: /note="Description of Artificial Sequence: Synthetic peptide"
EYPYEHSGYYHRP

SEQ ID NO: 144 - protein, 13 aa, Artificial Sequence
  source: /note="Description of Artificial Sequence: Synthetic peptide"
EYPYPHSGYYHRP

SEQ ID NO: 145 - protein, 13 aa, Artificial Sequence
  source: /note="Description of Artificial Sequence: Synthetic peptide"
EYTFPGAGYYHRP

SEQ ID NO: 146 - protein, 13 aa, Artificial Sequence
  source: /note="Description of Artificial Sequence: Synthetic peptide"
EYPYDHSGYYHRP

SEQ ID NO: 147 - protein, 13 aa, Artificial Sequence
  source: /note="Description of Artificial Sequence: Synthetic peptide"
EFPYDHSGYYHRP

SEQ ID NO: 148 - protein, 13 aa, Artificial Sequence
  source: /note="Description of Artificial Sequence: Synthetic peptide"
EFPYAHSGYYHRP

SEQ ID NO: 149 - protein, 13 aa, Artificial Sequence
  source: /note="Description of Artificial Sequence: Synthetic peptide"
EFTFPGAGYYHRP

SEQ ID NO: 150 - protein, 13 aa, Artificial Sequence
  source: /note="Description of Artificial Sequence: Synthetic peptide"
EYPYAHSGYFHRP

SEQ ID NO: 151 - protein, 13 aa, Artificial Sequence
  source: /note="Description of Artificial Sequence: Synthetic peptide"
EYDFPGAGYYHRP

SEQ ID NO: 152 - protein, 13 aa, Artificial Sequence
  source: /note="Description of Artificial Sequence: Synthetic peptide"
EYDFPGSGYYHRP

SEQ ID NO: 153 - protein, 13 aa, Artificial Sequence
  source: /note="Description of Artificial Sequence: Synthetic peptide"
EFDYPGSGYYHRP

SEQ ID NO: 154 - protein, 13 aa, Artificial Sequence
  source: /note="Description of Artificial Sequence: Synthetic peptide"
EYSFPGAGYYHRP

SEQ ID NO: 155 - protein, 13 aa, Artificial Sequence
  source: /note="Description of Artificial Sequence: Synthetic peptide"
EFDFPGSGYYHRP

SEQ ID NO: 156 - protein, 13 aa, Artificial Sequence
  source: /note="Description of Artificial Sequence: Synthetic peptide"
EFDFPGAGYYHRP

SEQ ID NO: 157 - protein, 13 aa, Artificial Sequence
  source: /note="Description of Artificial Sequence: Synthetic peptide"
EFPFPGSGYYHRP

SEQ ID NO: 158 - protein, 13 aa, Artificial Sequence
  source: /note="Description of Artificial Sequence: Synthetic peptide"
EFNFPGAGYYHRP

SEQ ID NO: 159 - protein, 13 aa, Artificial Sequence
  source: /note="Description of Artificial Sequence: Synthetic peptide"
EFTYPGSGYYHRP

SEQ ID NO: 160 - protein, 13 aa, Artificial Sequence
  source: /note="Description of Artificial Sequence: Synthetic peptide"
EFPFPGAGYYHRP

SEQ ID NO: 161 - protein, 13 aa, Artificial Sequence
  source: /note="Description of Artificial Sequence: Synthetic peptide"
EFNFPGSGYYHRP

SEQ ID NO: 162 - protein, 13 aa, Artificial Sequence
  source: /note="Description of Artificial Sequence: Synthetic peptide"
EYPYAHAGYYHRP

SEQ ID NO: 163 - protein, 13 aa, Artificial Sequence
  source: /note="Description of Artificial Sequence: Synthetic peptide"
EYPYPFSGYYHRP

SEQ ID NO: 164 - protein, 13 aa, Artificial Sequence
  source: /note="Description of Artificial Sequence: Synthetic peptide"
EYNFIGAGYYHRP

SEQ ID NO: 165 - protein, 13 aa, Artificial Sequence
  source: /note="Description of Artificial Sequence: Synthetic peptide"
EFPYPFAGYYHRP

SEQ ID NO: 166 - protein, 13 aa, Artificial Sequence
  source: /note="Description of Artificial Sequence: Synthetic peptide"
EYTYEHSGYYHRP

SEQ ID NO: 167 - protein, 13 aa, Artificial Sequence
  source: /note="Description of Artificial Sequence: Synthetic peptide"
EFDFVGAGYYHRP

SEQ ID NO: 168 - protein, 13 aa, Artificial Sequence
  source: /note="Description of Artificial Sequence: Synthetic peptide"
EYDFAGSGYYHRP

SEQ ID NO: 169 - protein, 13 aa, Artificial Sequence
  source: /note="Description of Artificial Sequence: Synthetic peptide"
EFAFPGAGYYHRP

SEQ ID NO: 170 - protein, 13 aa, Artificial Sequence
  source: /note="Description of Artificial Sequence: Synthetic peptide"
EYVFPGAGYYHRP

SEQ ID NO: 171 - protein, 13 aa, Artificial Sequence
  source: /note="Description of Artificial Sequence: Synthetic peptide"
EYPYPFAGYYHRP

SEQ ID NO: 172 - protein, 13 aa, Artificial Sequence
  source: /note="Description of Artificial Sequence: Synthetic peptide"
EYPYSHAGYYHRP

SEQ ID NO: 173 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYDYSGYYHRPISINYRTEIDKPSQHHHHHH

SEQ ID NO: 174 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacgactattctggttactaccatcgccccatttccattaattaccgcacagaaattgacaaaccatcccagcaccatcaccaccaccac

SEQ ID NO: 175 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYEHSGYYHRPISINYRTEIDKPSQHHHHHH

SEQ ID NO: 176 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacgagcattctgggtactatcatcgtccgatttccattaattaccgcacagaaattgacaaaccatcccagcaccatcaccaccaccac

SEQ ID NO: 177 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYPHSGYYHRPISINYRTEIDKPSQHHHHHH

SEQ ID NO: 178 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacccgcattctggttactaccatcgaccgatttccattaattaccgcacagaaattgacaaaccatcccagcaccatcaccaccaccac

SEQ ID NO: 179 - protein, 111 aa, Artificial Sequence
  source: /note="Description of Artificial Sequence: Synthetic polypeptide"
MGVSDVPRDLEVVAATPTSLLISWDAPADGGYGYYRITYGETGGNSPVQEFTVPSSKGTATISGLKPGVDYTITVYAVEYTFPGAGYYHRPISINYRTEIDKPSQHHHHHH

SEQ ID NO: 180 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggagggtacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaatacaccttcccgggcgccggttactaccatcgtccaatttccattaattaccgcacagaaattgacaaaccatcccagcaccatcaccaccaccac

SEQ ID NO: 181 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYDHSGYYHRPISINYRTEIDKPSQHHHHHH

SEQ ID NO: 182 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacgaccattctggttactaccatcgtcccatttccattaattaccgcacagaaattgacaaaccatcccagcaccatcaccaccaccac

SEQ ID NO: 183 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEFPYDHSGYYHRPISINYRTEIDKPSQHHHHHH

SEQ ID NO: 184 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaattcccgtacgaccattctggttactaccatcggcccatttccattaattaccgcacagaaattgacaaaccatcccagcaccatcaccaccaccac

SEQ ID NO: 185 - protein, 111 aa, Artificial Sequence
  source: /note="Description of Artificial Sequence: Synthetic polypeptide"
MGVSDVPRDLEVVAATPTSLLISWDAPADGGYGYYRITYGETGGNSPVQEFTVPVSKSTATISGLKPGVDYTITVYAVEYTFPGAGYYHRPISINYRTEIDKPSQHHHHHH

SEQ ID NO: 186 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacggggggtacggttattaccgcatcacttacggcgaaacaggaggcaatagccctgtccaggagttcactgtgcctgtttctaaaagtacagctaccatcagcggccttaaacctggcgttgattataccatcactgtgtatgctgtcgaatacaccttccccggcgccggttactaccatcgtccaatttccattaattaccgcacagaaattgacaaaccatcccagcaccatcaccaccaccac

SEQ ID NO: 187 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEFPYAHSGYYHRPISINYRTEIDKPSQHHHHHH

SEQ ID NO: 188 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaattcccgtacgcgcattctgggtactaccatcgtccgatttccattaattaccgcacagaaattgacaaaccatcccagcaccatcaccaccaccac

SEQ ID NO: 189 - protein, 111 aa, Artificial Sequence
  source: /note="Description of Artificial Sequence: Synthetic polypeptide"
MGVSDVPRDLEVVAATPTSLLISWDAPAGDGYGYYRITYGETGGNSPVQEFTVPVSKGTATISGLKPGVDYTITVYAVEFTFPGAGYYHRPISINYRTEIDKPSQHHHHHH

SEQ ID NO: 190 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggggacggttacggttattaccgcatcacttacggcgaaacaggaggcaatagccctgtccaggagttcactgtgcccgtttctaaaggtacagctaccatcagcggccttaaacctggcgttgattataccatcactgtgtatgctgtcgaattcaccttcccgggcgccggttactaccatcgtccaatttccattaattaccgcacagaaattgacaaaccatcccagcaccatcaccaccaccac

SEQ ID NO: 191 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYAHSGYFHRPISINYRTEIDKPSQHHHHHH

SEQ ID NO: 192 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacgcgcattctggttacttccatcgtccgatttccattaattaccgcacagaaattgacaaaccatcccagcaccatcaccaccaccac

SEQ ID NO: 193 - protein, 111 aa, Artificial Sequence
  source: /note="Description of Artificial Sequence: Synthetic polypeptide"
MGVSDVPRDLEVVAATPTSLLISWAAPAGGGYGYYRITYGETGGNSPVQEFTVPVSKGTATISGLKPGVDYTITVYAVEYDFPGAGYYHRPISINYRTEIDKPSQHHHHHH

SEQ ID NO: 194 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggccgctccggctggtggtggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttcccgggcgccggttactaccatcgtccaatttccattaattaccgcacagaaattgacaaaccatcccagcaccatcaccaccaccac

SEQ ID NO: 195 - protein, 110 aa, Artificial Sequence
  source: /note="Description of Artificial Sequence: Synthetic polypeptide"
MGVSDVPRDLEVVAATPTSLLISWDAPADAYGYYRITYGETGGNSPVQEFTVPSSKGTATISGLKPGVDYTITVYAVEYDFPGSGYYHRPISINYRTEIDKPSQHHHHHH

SEQ ID NO: 196 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgataagctgggacgctccggctgacgcgtacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaatacgacttccccggcagcggttactaccatcgtccaatttccattaattaccgcacagaaattgacaaaccatcccagcaccatcaccaccaccac

SEQ ID NO: 197 - protein, 110 aa, Artificial Sequence
  source: /note="Description of Artificial Sequence: Synthetic polypeptide"
MGVSDVPRDLEVVAATPTSLLISWDAPADAYGYYRITYGETGGNSPVQEFTVPVSKGTATISGLKPGVDYTITVYAVEFDYPGSGYYHRPISINYRTEIDKPSQHHHHHH

SEQ ID NO: 198 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacgcgtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgactaccccggctccggttactaccatcgtccaatttccattaattaccgcacagaaattgacaaaccatcccagcaccatcaccaccaccac

SEQ ID NO: 199 - protein, 111 aa, Artificial Sequence
  source: /note="Description of Artificial Sequence: Synthetic polypeptide"
MGVSDVPRDLEVVAATPTSLLISWDAPADGAYGYYRITYGETGGNSPVQEFTVPVSKGTATISGLKPGVDYTITVYAVEYSFPGAGYYHRPISINYRTEIDKPSQHHHHHH

SEQ ID NO: 200 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggggcatacggttattaccgcatcacttacggcgaaacaggaggcaatagccctgtccaggagttcactgtgcctgtttctaagggtacagctaccatcagcggccttaaacctggcgttgattataccatcactgtgtatgctgtcgaatactccttccccggcgccggttactaccatcgtccaatttccattaattaccgcacagaaattgacaaaccatcccagcaccatcaccaccaccac

SEQ ID NO: 201 - protein, 110 aa, Artificial Sequence
  source: /note="Description of Artificial Sequence: Synthetic polypeptide"
MGVSDVPRDLEVVAATPTSLLISWDAPAEGYGYYRITYGETGGNSPVQEFTVPVSKGTATISGLKPGVDYTITVYAVEFDFPGSGYYHRPISINYRTEIDKPSQHHHHHH

SEQ ID NO: 202 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgagggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggctccggttactaccatcgtccaatttccattaattaccgcacagaaattgacaaaccatcccagcaccatcaccaccaccac

SEQ ID NO: 203 - protein, 111 aa, Artificial Sequence
  source: /note="Description of Artificial Sequence: Synthetic polypeptide"
MGVSDVPRDLEVVAATPTSLLISWDAPADEAYGYYRITYGETGGNSPVQEFTVPVSKGTATISGLKPGVDYTITVYAVEFDFPGAGYYHRPISINYRTEIDKPSQHHHHHH

SEQ ID NO: 204 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacgaggcgtacggttattaccgcatcacttacggcgaaacaggaggcaatagccctgtccaggagttcactgtgcctgtttctaaaggtacagctaccatcagcggccttaaacctggtgttgattataccatcactgtgtatgctgtcgaattcgacttccccggcgccggttactaccatcgtccaatttccattaattaccgcacagaaattgacaaaccatcccagcaccatcaccaccaccac

SEQ ID NO: 205 - protein, 111 aa, Artificial Sequence
  source: /note="Description of Artificial Sequence: Synthetic polypeptide"
MGVSDVPRDLEVVAATPTSLLISWDAPADGGYGYYRITYGETGGNSPVQEFTVPVSKGTATISGLKPGVDYTITVYAVEFDFPGAGYYHRPISINYRTEIDKPSQHHHHHH

SEQ ID NO: 206 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggtggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttcccgggcgccggttactaccatcgtccaatttccattaattaccgcacagaaattgacaaaccatcccagcaccatcaccaccaccac

SEQ ID NO: 207 - protein, 110 aa, Artificial Sequence
  source: /note="Description of Artificial Sequence: Synthetic polypeptide"
MGVSDVPRDLEVVAATPTSLLISWDAPADGYGYYRITYGETGGNSPVQEFTVPVSKGTATISGLKPGVDYTITVYAVEFPFPGSGYYHRPISINYRTEIDKPSQHHHHHH

SEQ ID NO: 208 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattccccttccccggctccggttactaccatcgtccaatttccattaattaccgcacagaaattgacaaaccatcccagcaccatcaccaccaccac

SEQ ID NO: 209 - protein, 110 aa, Artificial Sequence
  source: /note="Description of Artificial Sequence: Synthetic polypeptide"
MGVSDVPRDLEVVAATPTSLLISWDAPAEGYGYYRITYGETGGNSPVQEFTVPVSKGTATISGLKPGVDYTITVYAVEFDFPGAGYYHRPISINYRTEIDKPSQHHHHHH

SEQ ID NO: 210 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaagggtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggcgccggttactaccatcgtccaatttccattaattaccgcacagaaattgacaaaccatcccagcaccatcaccaccaccac

SEQ ID NO: 211 - protein, 111 aa, Artificial Sequence
  source: /note="Description of Artificial Sequence: Synthetic polypeptide"
MGVSDVPRDLEVVAATPTSLLISWDAPAGGGYGYYRITYGETGGNSPVQEFTVPVSKGTATISGLKPGVDYTITVYAVEFDFPGSGYYHRPISINYRTEIDKPSQHHHHHH

SEQ ID NO: 212 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggcggggggtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttcccgggctccggttactaccatcgtccaatttccattaattaccgcacagaaattgacaaaccatcccagcaccatcaccaccaccac

SEQ ID NO: 213 - protein, 111 aa, Artificial Sequence
  source: /note="Description of Artificial Sequence: Synthetic polypeptide"
MGVSDVPRDLEVVAATPTSLLISWDAPAADAYGYYRITYGETGGNSPVQEFTVPVSKGTATISGLKPGVDYTITVYAVEFNFPGAGYYHRPISINYRTEIDKPSQHHHHHH

SEQ ID NO: 214 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgccgatgcttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcaacttcccgggcgccggttactaccatcgtccaatttccattaattaccgcacagaaattgacaaaccatcccagcaccatcaccaccaccac

SEQ ID NO: 215 - protein, 113 aa, Artificial Sequence
  source: /note="Description of Artificial Sequence: Synthetic polypeptide"
MGVSDVPRDLEVVAATPTSLLISWDAPAEAGKHYGYYRITYGETGGNSPVQEFTVPVSKGTATISGLKPGVDYTITVYAVEFDFPGAGYYHRPISINYRTEIDKPSQHHHHHH

SEQ ID NO: 216 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaagcaggtaagcactacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttcccgggcgccggttactaccatcgtccaatttccattaattaccgcacagaaattgacaaaccatcccagcaccatcaccaccaccac

SEQ ID NO: 217 - protein, 110 aa, Artificial Sequence
  source: /note="Description of Artificial Sequence: Synthetic polypeptide"
MGVSDVPRDLEVVAATPTSLLISWDAPAEAYGYYRITYGETGGNSPVQEFTVPVSKGTATISGLKPGVDYTITVYAVEFTYPGSGYYHRPISINYRTEIDKPSQHHHHHH

SEQ ID NO: 218 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaagcatacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcacctaccccggctccggttactaccatcgtccaatttccattaattaccgcacagaaattgacaaaccatcccagcaccatcaccaccaccac

SEQ ID NO: 219 - protein, 110 aa, Artificial Sequence
  source: /note="Description of Artificial Sequence: Synthetic polypeptide"
MGVSDVPRDLEVVAATPTSLLISWDAPAAAYGYYRITYGETGGNSPVQEFTVPVSKGTATISGLKPGVDYTITVYAVEYDFPGSGYYHRPISINYRTEIDKPSQHHHHHH

SEQ ID NO: 220 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcagcctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttccccggctccggttactaccatcgtccaatttccattaattaccgcacagaaattgacaaaccatcccagcaccatcaccaccaccac

SEQ ID NO: 221 - protein, 111 aa, Artificial Sequence
  source: /note="Description of Artificial Sequence: Synthetic polypeptide"
MGVSDVPRDLEVVAATPTSLLISWDAPAGGGYGYYRITYGETGGNSPVQEFTVPSSKGTATISGLKPGVDYTITVYAVEFDFPGAGYYHRPISINYRTEIDKPSQHHHHHH

SEQ ID NO: 222 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggtgggggatacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaattcgacttcccgggcgccggttactaccatcgtccaatttccattaattaccgcacagaaattgacaaaccatcccagcaccatcaccaccaccac

SEQ ID NO: 223 - protein, 110 aa, Artificial Sequence
  source: /note="Description of Artificial Sequence: Synthetic polypeptide"
MGVSDVPRDLEVVAATPTSLLISWDAPAGGYGYYRITYGETGGNSPVQEFTVPVSKGTATISGLKPGVDYTITVYAVEFDFPGSGYYHRPISINYRTEIDKPSQHHHHHH

SEQ ID NO: 224 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgggggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggctccggttactaccatcgtccaatttccattaattaccgcacagaaattgacaaaccatcccagcaccatcaccaccaccac

SEQ ID NO: 225 - protein, 110 aa, Artificial Sequence
  source: /note="Description of Artificial Sequence: Synthetic polypeptide"
MGVSDVPRDLEVVAATPTSLLISWDAPADGYGYYRITYGETGGNSPVQEFTVPVFKGTATISGLKPGVDYTITVYAVEFDYPGSGYYHRPISINYRTEIDKPSQHHHHHH

SEQ ID NO: 226 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggttacggttattaccgcatcacttacggcgaaacaggaggcaatagccctgtccaggagttcactgtgcctgtttttaaaggtacagctaccatcagcggccttaaacctggcgttgattataccatcactgtgtatgctgtcgaattcgactaccccggctccggttactaccatcgtccaatttccattaattaccgcacagaaattgacaaaccatcccagcaccatcaccaccaccac

SEQ ID NO: 227 - protein, 111 aa, Artificial Sequence
  source: /note="Description of Artificial Sequence: Synthetic polypeptide"
MGVSDVPRDLEVVAATPTSLLISWDAPAAGGYGYYRITYGETGGNSPVQEFTVPSSKGTATISGLKPGVDYTITVYAVEYDFPGAGYYHRPISINYRTEIDKPSQHHHHHH

SEQ ID NO: 228 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcgggggggtacggttattaccgcatcacttacggcgaaacaggaggcaatagccctgtccaggagttcactgtgcctagttctaaaggtacagctaccatcagcggccttaaacctggcgttgattataccatcactgtatatgctgtcgaatacgacttccccggcgccggttactaccatcgtccaatttccattaattaccgcacagaaattgacaaaccatcccagcaccatcaccaccaccac

SEQ ID NO: 229 - protein, 110 aa, Artificial Sequence
  source: /note="Description of Artificial Sequence: Synthetic polypeptide"
MGVSDVPRDLEVVAATPTSLLISWDAPADAYGYYRITYGETGGNSPVQEFTVPGSKGTATISGLKPGVDYTITVYAVEFDFPGSGYYHRPISINYRTEIDKPSQHHHHHH

SEQ ID NO: 230 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatgcttacggttattaccgcatcacttacggcgaaacaggaggcaatagcccagtccaggagttcactgtgcctggttctaaaggtacagctaccatcagcggccttaaacctggcgttgattataccatcactgtgtatgctgtcgaattcgacttccccggctccggttactaccatcgtccaatttccattaattaccgcacagaaattgacaaaccatcccagcaccatcaccaccaccac

SEQ ID NO: 231 - protein, 110 aa, Artificial Sequence
  source: /note="Description of Artificial Sequence: Synthetic polypeptide"
MGVSDVPRDLEVVAATPTSLLISWDAPAAAYGYYRITYGETGGNSPVQEFTVPSSKGTATISGLKPGVDYTITVYAVEFDFPGSGYYHRPISINYRTEIDKPSQHHHHHH

SEQ ID NO: 232 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcggcttacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaattcgacttccccggctccggttactaccatcgcccaatttccattaattaccgcacagaaattgacaaaccatcccagcaccatcaccaccaccac

SEQ ID NO: 233 - protein, 110 aa, Artificial Sequence
  source: /note="Description of Artificial Sequence: Synthetic polypeptide"
MGVSDVPRDLEVVAATPTSLLISWDAPAAGYGYYRITYGETGGNSPVQEFTVPVSKGTATISGLKPGVDYTITVYAVEFPFPGSGYYHRPISINYRTEIDKPSQHHHHHH

SEQ ID NO: 234 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcgggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattccccttccccggctccggttactaccatcgtccaatttccattaattaccgcacagaaattgacaaaccatcccagcaccatcaccaccaccac

SEQ ID NO: 235 - protein, 110 aa, Artificial Sequence
  source: /note="Description of Artificial Sequence: Synthetic polypeptide"
MGVSDVPRDLEVVAATPTSLLISWDAPAGGYGYYRITYGETGGNSPVQEFTVPSSKGTATISGLKPGVDYTITVYAVEFDYPGSGYYHRPISINYRTEIDKPSQHHHHHH

SEQ ID NO: 236 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgggggatacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaattcgactaccccggctccggttactaccatcgtccaatttccattaattaccgcacagaaattgacaaaccatcccagcaccatcaccaccaccac

SEQ ID NO: 237 - protein, 112 aa, Artificial Sequence
  source: /note="Description of Artificial Sequence: Synthetic polypeptide"
MGVSDVPRDLEVVAATPTSLLISWDAPAGAASYGYYRITYGETGGNSPVQEFTVPVSKGTATISGLKPGVDYTITVYAVEFPFPGAGYYHRPISINYRTEIDKPSQHHHHHH

SEQ ID NO: 238 - DNA, 336 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggggcagcgtcctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattccccttccccggcgccggttactaccatcgtccaatttccattaattaccgcacagaaattgacaaaccatcccagcaccatcaccaccaccac

SEQ ID NO: 239 - protein, 110 aa, Artificial Sequence
  source: /note="Description of Artificial Sequence: Synthetic polypeptide"
MGVSDVPRDLEVVAATPTSLLISWDAPAGAYGYYRITYGETGGNSPVQEFTVPVSKGTATISGLKPGVDYTITVYAVEFDFPGSGYYHRPISINYRTEIDKPSQHHHHHH

SEQ ID NO: 240 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggcgcgtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggctccggttactaccatcgtccaatttccattaattaccgcacagaaattgacaaaccatcccagcaccatcaccaccaccac

SEQ ID NO: 241 - protein, 110 aa, Artificial Sequence
  source: /note="Description of Artificial Sequence: Synthetic polypeptide"
MGVSDVPRDLEVVAATPTSLLISWDPPAEGYGYYRITYGETGGNSPVQEFTVPVSKGTATISGLKPGVDYTITVYAVEFNFPGSGYYHRPISINYRTEIDKPSQHHHHHH

SEQ ID NO: 242 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggaccctccggctgaaggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcaacttccccggctccggttactaccatcgtccaatttccattaattaccgcacagaaattgacaaaccatcccagcaccatcaccaccaccac

SEQ ID NO: 243 - protein, 110 aa, Artificial Sequence
  source: /note="Description of Artificial Sequence: Synthetic polypeptide"
MGVSDVPRDLEVVAATPTSLLISWDAPAGGYGYYRITYGETGGNSPVQEFTVPSSKGTATISGLKPGVDYTITVYAVEFDFPGSGYYHRPISINYRTEIDKPSQHHHHHH

SEQ ID NO: 244 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgggggctacggttattaccgcatcacttacggcgaaacaggaggcaatagccctgtccaggagttcactgtgcctagttctaaaggtacagctaccatcagcggccttaaacctggcgttgattataccatcactgtgtatgctgtcgaattcgacttcccgggctccggttactaccatcgtccaatttccattaattaccgcacagaaattgacaaaccatcccagcaccatcaccaccaccac

SEQ ID NO: 245 - protein, 110 aa, Artificial Sequence
  source: /note="Description of Artificial Sequence: Synthetic polypeptide"
MGITDVPRDLEVVAATPTSLLISWNPPDVNYGYYRITYGETGGNSPLQEFTVPVSKGTATISGLKPGVDYTITVYAVEYPYAHAGYYHRPISINYRTEIDKPSQHHHHHH

SEQ ID NO: 246 - DNA, 330 bp, Artificial Sequence
  source: /note="Description of Artificial Sequence: Synthetic polynucleotide"
atgggtatcacggatgtgccgcgagacttggaagtggttgctgccacccccaccagcctgctgatcagctggaacccgccggatgtgaattacggttattatcgcatcacttacggggaaacaggaggcaatagccctttgcaggagttcactgtgcctgtttctaaaggtacagctaccatcagcggccttaaacctggcgttgattataccatcactgtgtatgctgtcgaatatccgtacgcgcacgctggttactaccatcgtccgatttccattaattaccgcacagaaattgacaaaccatcccagcaccatcaccaccaccac

SEQ ID NO: 247 - protein, 111 aa, Artificial Sequence
  source: /note="Description of Artificial Sequence: Synthetic polypeptide"
MGVSDVPRDLEVVAATPTSLLISWDAPAGDGYGYYRITYGETGGNSPVQEFTVPVSKGTATISGLKPGVDYTITVYAVEFDFPGAGYYHRPISINYRTEIDKPSQHHHHHH

SEQ ID NO: 248 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggggacgggtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggcgccggttactaccatcgtccaatttccattaattaccgcacagaaattgacaaaccatcccagcaccatcaccaccaccac

SEQ ID NO: 249 - protein, 111 aa, Artificial Sequence
  source: /note="Description of Artificial Sequence: Synthetic polypeptide"
MGVSDVPRDLEVVAATPTSLLISWDAPAGGGYGYYRITYGETGGNSPVQEFTVPVSKGTATISGLKPGVDYTITVYAVEFTFPGAGYYHRPISINYRTEIDKPSQHHHHHH

SEQ ID NO: 250 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggtggtggatacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcaccttcccgggcgccggttactaccatcgtccaatttccattaattaccgcacagaaattgacaaaccatcccagcaccatcaccaccaccac

SEQ ID NO: 251 - protein, 111 aa, Artificial Sequence
  source: /note="Description of Artificial Sequence: Synthetic polypeptide"
MGVSDVPRDLEVVAATPTSLLISWDAPAEGGYGYYRITYGETGGNSPVQEFTVPVSKGTATISGLKPGVDYTITVYAVEFDFPGAGYYHRPISINYRTEIDKPSQHHHHHH

SEQ ID NO: 252 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgagggcggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggcgccggttactaccatcgtccaatttccattaattaccgcacagaaattgacaaaccatcccagcaccatcaccaccaccac

SEQ ID NO: 253 - protein, 110 aa, Artificial Sequence
  source: /note="Description of Artificial Sequence: Synthetic polypeptide"
MGVSDVPRDLEVVAATPTSLLISWDAPAEAYGYYRITYGETGGNSPVQEFTVPVSKGTATISGLKPGVDYTITVYAVEYDFPGSGYYHRPISINYRTEIDKPSQHHHHHH

SEQ ID NO: 254 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaggcttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttccccggctccggttactaccatcgtccaatttccattaattaccgcacagaaattgacaaaccatcccagcaccatcaccaccaccac

SEQ ID NO: 255 - protein, 113 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEYPYPFSGYYHRPISINYRTEIDKPSQHHHHHH

SEQ ID NO: 256 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaatacccgtacccgttttctggttactaccatcgtcccatttccattaattaccgcacagaaattgacaaaccatcccagcaccatcaccaccaccac

SEQ ID NO: 257 - protein, 111 aa, Artificial Sequence
  source: /note="Description of Artificial Sequence: Synthetic polypeptide"
MGVSDVPRDLEVVAATPTSLLISWDAPADGGYGYYRITYGETGGNSPVQEFTVPGSKGTATISGLKPGVDYTITVYAVEYDFPGAGYYHRPISINYRTEIDKPSQHHHHHH

SEQ ID NO: 258 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacggcgggtacggttattaccgcatcacttacggcgaaacaggaggcaatagccctgtccaggagttcactgtgcctggttctaaaggtacagctaccatcagcggccttaaacctggcgttgattataccatcactgtgtatgctgtcgaatacgacttcccgggcgccggttactaccatcgtccaatttccattaattaccgcacagaaattgacaaaccatcccagcaccatcaccaccaccac

SEQ ID NO: 259 - protein, 111 aa, Artificial Sequence
  source: /note="Description of Artificial Sequence: Synthetic polypeptide"
MGVSDVPRDLEVVAATPTSLLISWDAPAGGGYGYYRITYGETGGNSPVQEFTVPVSKGTATISGLKPGVDYTITVYAVEYNFIGAGYYHRPISINYRTEIDKPSQHHHHHH

SEQ ID NO: 260 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgggggtggatacggttattaccgsatcacttacggcgaaacaggaggcaatagccctgtccaggagttcactgtgcctgtttctaaaggtacagctaccatcagcggccttaaacctggcgttgattataccatcactgtgtatgctgtcgaatacaacttcatcggcgccggttactaccatcgtccaatttccattaattaccgcacagaaattgacaaaccatcccagcaccatcaccaccaccac

SEQ ID NO: 261 - protein, 111 aa, Artificial Sequence
  source: /note="Description of Artificial Sequence: Synthetic polypeptide"
MGVSDVPRDLEVVAATPTSLLISWDAPADGAYGYYRITYGETGGNSPVQEFTVPVSKGTATISGLKPGVDYTITVYAVEFPYPFAGYYHRPISINYRTEIDKPSQHHHHHH

SEQ ID NO: 262 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacggtgcctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcccctaccccttcgccggttactaccatcgtccaatttccattaattaccgcacagaaattgacaaaccatcccagcaccatcaccaccaccac

SEQ ID NO: 263 - protein, 113 aa, Artificial Sequence
  source: /note="Description of Artificial Sequence: Synthetic polypeptide"
MGVSDVPRDLEVVAATPTSLLISWSEKLDGKARRGYYRITYGETGGNSPVQQFTVPGSKGTATISGLKPGVDYTITVYAVEFPYDHSGYYHRPISINYRTEIDKPSQHHHHHH

SEQ ID NO: 264 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggtcggagaagttggacgggaaggcgcgccgcgggtattaccgcatcacatacggcgaaacaggaggcaatagccctgtccagcagttcactgtgcctggttctaaaggtacagctaccatcagcggccttaaacctggcgttgattataccatcactgtgtatgctgtcgaattcccgtacgaccattctggttactaccatcgtcccatttccattaattaccgcacagaaattgacaaaccatcccagcaccatcaccaccaccac

SEQ ID NO: 265 - protein, 114 aa, Artificial Sequence
  source: /note="Description of Artificial Sequence: Synthetic polypeptide"
MGVSDVPRDLEVVAATPTSLLISWSPRDSTGLVRRGYYRITYGETGGNSPVQQFTVPGSKGTATISGLKPGVDYTITVYAVEYPYDHSGYYHRPISINYRTEIDKPSQHHHHHH

SEQ ID NO: 266 - DNA, 342 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggagcccgcgggactccaccggcttggtgaggcgggggtattaccgcatcacttacggcgaaacaggaggcaatagccctgttcagcagttcactgtgcctggttctaaaggtacagctaccatcagcggccttaaacctggcgttgattataccatcactgtgtatgctgtcgaatacccgtacgaccattctggttactaccatcggcccatttccattaattaccgcacagaaattgacaaaccatcccagcaccatcaccaccaccac

SEQ ID NO: 267 - protein, 113 aa, Artificial Sequence
  source: /note="Description of Artificial Sequence: Synthetic polypeptide"
MGVSDVPRDLEVVAATPTSLLISWGDVRTNEARQGYYRITYGETGGNSPLQGFTVPGSKGTATISGLKPGVDYTITVYAVEYTYEHSGYYHRPISINYRTEIDKPSQHHHHHH

SEQ ID NO: 268 - DNA, 339 bp, Artificial Sequence
  source: /note="Description of Artificial Sequence: Synthetic polynucleotide"
atgggagtttctgatgtgccgcgcgacctggaagtggttgctgccacccccaccagcctgctgatcagctggggcgacgtccggacgaacgaggcgcggcagggctattaccggatcacttacggcgaaacaggaggcaatagccctctccaggggttcactgtgcctggttctaaaggtacagctaccatcagcggccttaaacctggcgttgattataccatcactgtgtatgctgtcgagtatacgtacgagcattctggttactaccatcgtccgatttccattaattaccgcacagaaattgacaaaccatcccagcaccatcaccaccaccac

SEQ ID NO: 269 - protein, 111 aa, Artificial Sequence
  source: /note="Description of Artificial Sequence: Synthetic polypeptide"
MGVSDVPRDLEVVAATPTSLLISWDAPAGGGYGYYRITYGETGGNSPVQEFTVPVSKGTATISGLKPGVDYTITVYAVEFDFVGAGYYHRPISINYRTEIDKPSQHHHHHH

SEQ ID NO: 270 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggggggggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttcgtcggcgccggttactaccatcgtccaatttccattaattaccgcacagaaattgacaaaccatcccagcaccatcaccaccaccac

SEQ ID NO: 271 - protein, 110 aa, Artificial Sequence
  source: /note="Description of Artificial Sequence: Synthetic polypeptide"
MGVSDVPRDLEVVAATPTSLLISWDAPAAAYGYYRITYGETGGNSPVQEFTVPVSKGTATISGLKPGVDYTITVYAVEYDFAGSGYYHRPISINYRTEIDKPSQHHHHHH

SEQ ID NO: 272 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcggcctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttcgcgggctccggttactaccatcgtccaatttccattaattaccgcacagaaattgacaaaccatcccagcaccatcaccaccaccac

SEQ ID NO: 273 - protein, 110 aa, Artificial Sequence
  source: /note="Description of Artificial Sequence: Synthetic polypeptide"
MGVSDVPRDLEVVAATPTSLLISWDAPADAYGYYRITYGETGGNSPVQEFTVPSSKGTATISGLKPGVDYTITVYAVEFAFPGAGYYHRPISINYRTEIDKPSQHHHHHH

SEQ ID NO: 274 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacgcgtacggttattaccgcatcacttacggcgaaacaggaggcaatagccctgtccaggagttcactgtgcctagttctaaaggtacagctaccatcagcggccttaaacctggcgttgattataccatcactgtatatgctgtcgaattcgccttccccggcgccggttactaccatcgtccaatttccattaattaccgcacagaaattgacaaaccatcccagcaccatcaccaccaccac

SEQ ID NO: 275 - protein, 110 aa, Artificial Sequence
  source: /note="Description of Artificial Sequence: Synthetic polypeptide"
MGVSDVPRDLEVVAATPTSLLISWDAPAGGYGYYRITYGETGGNSPVQEFTVPVSKGTATISGLKPGVDYTITVYAVEYDFAGSGYYHRPISINYRTEIDKPSQHHHHHH

SEQ ID NO: 276 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctggaggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttcgcgggctccggttactaccatcgtccaatttccattaattaccgcacagaaattgacaaaccatcccagcaccatcaccaccaccac

SEQ ID NO: 277 - protein, 112 aa, Artificial Sequence
  source: /note="Description of Artificial Sequence: Synthetic polypeptide"
MGVSDVPRDLEVVAATPTSLLISWDAPAEAEAYGYYRITYGETGGNSPVQEFTVPVSKGTATISGLKPGVDYTITVYAVEYVFPGAGYYHRPISINYRTEIDKPSQHHHHHH

SEQ ID NO: 278 - DNA, 336 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaagcagaagcgtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgtcttccccggcgccggttactaccatcgtccaatttccattaattaccgcacagaaattgacaaaccatcccagcaccatcaccaccaccac

SEQ ID NO: 279 - protein, 111 aa, Artificial Sequence
  source: /note="Description of Artificial Sequence: Synthetic polypeptide"
MGVSDVPRDLEVVAATPTSLLISWDAPAEGAYGYYRITYGETGGNSPVQEFTVPVSKGTATISGLKPGVDYTITVYAVEYPYPFAGYYHRPISINYRTEIDKPSQHHHHHH

SEQ ID NO: 280 - DNA, 333 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgagggcgcttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacccctaccccttcgccggttactaccatcgtccaatttccattaattaccgcacagaaattgacaaaccatcccagcaccatcaccaccaccac

SEQ ID NO: 281 - protein, 110 aa, Artificial Sequence
  source: /note="Description of Artificial Sequence: Synthetic polypeptide"
MGVTDVPRDMEVVAATPTSLLISWQPPAVTYGYYRITYGETGGNSTLQQFTVPVYKGTATISGLKPGVDYTITVYAVEYPYDHSGYYHRPISINYRTEIDKPSQHHHHHH

SEQ ID NO: 282 - DNA, 330 bp, Artificial Sequence
  source: /note="Description of Artificial Sequence: Synthetic polynucleotide"
atgggtgtcaccgatgtgccgcgcgacatggaagtggttgctgccacccccaccagcctgctgatcagctggcagccgccggctgttacttacggttattatcgcatcacttacggcgaaacaggaggcaatagcactctccagcagttcactgtgcctgtttataaaggtacagctaccatcagcggccttaaacctggcgttgattataccatcactgtgtatgctgtcgaatacccgtacgaccattctgggtactaccatcggccgatttccattaattaccgcacagaaattgacaaaccatcccagcaccatcaccaccaccac

SEQ ID NO: 283 - protein, 110 aa, Artificial Sequence
  source: /note="Description of Artificial Sequence: Synthetic polypeptide"
MGVSDVPRDLEVVAATPTSLLISWDAPAAAYGYYRITYGETGGNSPVQEFTVPVSKGTATISGLKPGVDYTITVYAVEFDYPGSGYYHRPISINYRTEIDKPSQHHHHHH

SEQ ID NO: 284 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgctgcttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgactaccccggctccggttactaccatcgtccaatttccattaattaccgcacagaaattgacaaaccatcccagcaccatcaccaccaccac

SEQ ID NO: 285 - protein, 110 aa, Artificial Sequence
  source: /note="Description of Artificial Sequence: Synthetic polypeptide"
MGIVDVPRDLEVVAATPTSLLISWDPPAGAYGYYRITYGETGGNSPKQQFTVPGYKGTATISGLKPGVDYTITVYAVEYPYDHSGYYHRPISINYRTEIDKPSQHHHHHH

SEQ ID NO: 286 - DNA, 330 bp, Artificial Sequence
  source: /note="Description of Artificial Sequence: Synthetic polynucleotide"
atgggtatcgtggatgtgccgcgcgacctggaagtggttgctgccacccccaccagcctgctgatcagctgggacccgccggctggtgcttacggttattatcgcatcacttacggcgaaacaggaggcaatagcccaaagcagcagttcactgtgcctggttataaaggtacagctaccatcagcggccttaaacctggcgttgattataccatcactgtgtatgctgtcgaatacccgtacgaccattctggttactaccatcggccgatttccattaattaccgcacagaaattgacaaaccatcccagcaccatcaccaccaccac

SEQ ID NO: 287 - protein, 110 aa, Artificial Sequence
  source: /note="Description of Artificial Sequence: Synthetic polypeptide"
MGVSDVPRDLEVVAATPTSLLISWDAPAAGYGYYRITYGETGGNSPVQEFTVPVSKGTATISGLKPGVDYTITVYAVEYDFPGSGYYHRPISINYRTEIDKPSQHHHHHH

SEQ ID NO: 288 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgcggggtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaatacgacttccccggctccggttactaccatcgtccaatttccattaattaccgcacagaaattgacaaaccatcccagcaccatcaccaccaccac

SEQ ID NO: 289 - protein, 110 aa, Artificial Sequence
  source: /note="Description of Artificial Sequence: Synthetic polypeptide"
MGVSDVPRDLEVVAATPTSLLISWAPPSDAYGYYRITYGETGGNSPVQEFTVPIGKGTATISGLKPGVDYTITVYAVEYPYSHAGYYHRPISINYRTEIDKPSQHHHHHH

SEQ ID NO: 290 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggcgccgccttctgatgcgtacggttattaccgcatcacttacggcgaaacaggaggcaatagccctgtccaggagttcactgtgcctattggtaaaggtacagctaccatcagcggccttaaacctggcgttgattataccatcactgtgtatgctgtcgaatacccgtattcacatgctggttactaccatcgtccaatttccattaattaccgcacagaaattgacaaaccatcccagcaccatcaccaccaccac

SEQ ID NO: 291 - protein, 110 aa, Artificial Sequence
  source: /note="Description of Artificial Sequence: Synthetic polypeptide"
MGVSDVPRDLEVVAATPTSLLISWEPFSRLPGGGEYYRITYGETGGNSPLQQFTVPGSKGTATISGLKPGVDYTITVYAVEFPYDHSGYYHRPISINYRTGSGCHHHHHH

SEQ ID NO: 292 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggagccgttcagccggttgcccgggggcggcgagtattaccggatcacttacggcgaaacaggaggcaatagccctctgcagcagttcactgtgcctggttctaaaggtacagctaccatcagcggccttaaacctggcgttgattataccatcactgtgtatgctgtcgaattcccgtacgaccattctggttactaccatcggcccatttccattaattaccgcacaggtagcggttgccaccatcaccaccatcac

SEQ ID NO: 293 - protein, 107 aa, Artificial Sequence
  source: /note="Description of Artificial Sequence: Synthetic polypeptide"
MGVSDVPRDLEVVAATPTSLLISWDAPAEGYGYYRITYGETGGNSPVQEFTVPVSKGTATISGLKPGVDYTITVYAVEFDFPGAGYYHRPISINYRTGSGCHHHHHH

SEQ ID NO: 294 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgaagggtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggcgccggttactaccatcgtccaatttccattaattaccgcacaggtagcggttgccaccatcaccaccatcac

SEQ ID NO: 295 - protein, 108 aa, Artificial Sequence
  source: /note="Description of Artificial Sequence: Synthetic polypeptide"
MGVSDVPRDLEVVAATPTSLLISWDAPADGGYGYYRITYGETGGNSPVQEFTVPVSKGTATISGLKPGVDYTITVYAVEFDFPGAGYYHRPISINYRTGSGCHHHHHH

SEQ ID NO: 296 - DNA, 324 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgatggtggttacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttcccgggcgccggttactaccatcgtccaatttccattaattaccgcacaggtagcggttgccaccatcaccaccatcac

SEQ ID NO: 297 - protein, 108 aa, Artificial Sequence
  source: /note="Description of Artificial Sequence: Synthetic polypeptide"
MGVSDVPRDLEVVAATPTSLLISWDAPAEGGYGYYRITYGETGGNSPVQEFTVPVSKGTATISGLKPGVDYTITVYAVEFDFPGAGYYHRPISINYRTGSGCHHHHHH

SEQ ID NO: 298 - DNA, 324 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgagggcggctacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgacttccccggcgccggttactaccatcgtccaatttccattaattaccgcacaggtagcggttgccaccatcaccaccatcac

SEQ ID NO: 299 - protein, 107 aa, Artificial Sequence
  source: /note="Description of Artificial Sequence: Synthetic polypeptide"
MGVSDVPRDLEVVAATPTSLLISWDAPADAYGYYRITYGETGGNSPVQEFTVPVSKGTATISGLKPGVDYTITVYAVEFDYPGSGYYHRPISINYRTGSGCHHHHHH

SEQ ID NO: 300 - DNA, 321 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgctccggctgacgcgtacggttattaccgcatcacttacggcgaaacaggaggcaatagccctgtccaggagttcactgtgcctgtttctaaaggtacagctaccatcagcggccttaaacctggcgttgattataccatcactgtgtatgctgtcgaattcgactaccccggctccggttactaccatcgtccaatttccattaattaccgcacaggtagcggttgccaccatcaccaccatcac

SEQ ID NO: 301 - protein, 10 aa, Artificial Sequence
  source: /note="Description of Artificial Sequence: Synthetic peptide"
SWDPPSDDYG

SEQ ID NO: 302 - protein, 10 aa, Artificial Sequence
  source: /note="Description of Artificial Sequence: Synthetic peptide"
SWDAPADDYG

SEQ ID NO: 303 - protein, 10 aa, Artificial Sequence
  source: /note="Description of Artificial Sequence: Synthetic peptide"
SWDAPSDDYG

SEQ ID NO: 304 - protein, 110 aa, Artificial Sequence
  source: /note="Description of Artificial Sequence: Synthetic polypeptide"
MGVSDVPRDLEVVAATPTSLLISWDPPSDDYGYYRITYGETGGNSPVQEFTVPIGKGTATISGLKPGVDYTITVYAVEFPWPHAGYYHRPISINYRTEIDKPSQHHHHHH

SEQ ID NO: 305 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacccgccttcggatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgacaaaccatcccagcaccatcaccaccaccac

SEQ ID NO: 306 - protein, 110 aa, Artificial Sequence
  source: /note="Description of Artificial Sequence: Synthetic polypeptide"
MGVSDVPRDLEVVAATPTSLLISWDAPADDYGYYRITYGETGGNSPVQEFTVPIGKGTATISGLKPGVDYTITVYAVEFPWPHAGYYHRPISINYRTEIDKPSQHHHHHH

SEQ ID NO: 307 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgcgcctgcggatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgacaaaccatcccagcaccatcaccaccaccac

SEQ ID NO: 308 - protein, 110 aa, Artificial Sequence
  source: /note="Description of Artificial Sequence: Synthetic polypeptide"
MGVSDVPRDLEVVAATPTSLLISWDAPSDDYGYYRITYGETGGNSPVQEFTVPIGKGTATISGLKPGVDYTITVYAVEFPWPHAGYYHRPISINYRTEIDKPSQHHHHHH

SEQ ID NO: 309 - DNA, 330 bp, Artificial Sequence
  source: /note="Description of Artificial Sequence: Synthetic polynucleotide"
atgggagtttctgatgtgccgcgcgacctggaagtggttgctgccacccccaccagcctgctgatcagctgggacgcgccttcggatgattacggttattaccgcatcacttacggcgaaacaggaggcaatagccctgtccaggagttcactgtgcctattggtaaaggaacagctaccatcagcggccttaaacctggcgttgattataccatcactgtgtatgctgtcgagtttccgtggccacatgctggttactatcatcggccaatttccattaattaccgcacagaaattgacaaaccatcccagcaccatcaccaccaccac

SEQ ID NO: 310 - protein, 7 aa, Artificial Sequence
  source: /note="Description of Artificial Sequence: Synthetic peptide"
AGGGGSG

SEQ ID NO: 311 - protein, 12 aa, Artificial Sequence
  source: /note="Description of Artificial Sequence: Synthetic peptide"
GSGSGSGSGSGS

SEQ ID NO: 312 - protein, 8 aa, Artificial Sequence
  source: /note="Description of Artificial Sequence: Synthetic peptide"
QPDEPGGS

SEQ ID NO: 313 - protein, 17 aa, Artificial Sequence
  source: /note="Description of Artificial Sequence: Synthetic peptide"
ELQLEESAAEAQDGELD

SEQ ID NO: 314 - protein, 6 aa, Artificial Sequence
  source: /note="Description of Artificial Sequence: Synthetic peptide"
TVAAPS

SEQ ID NO: 315 - protein, 330 aa, Homo sapiens [sequence omitted]

SEQ ID NO: 316 - protein, 16 aa, Homo sapiens
DKTHTCPPCPAPELLG

SEQ ID NO: 317 - protein, 24 aa, Artificial Sequence
  source: /note="Description of Artificial Sequence: Synthetic peptide"
EPKSSDKTHTCPPCPAPELLGGPS

SEQ ID NO: 318 - protein, 24 aa, Artificial Sequence
  source: /note="Description of Artificial Sequence: Synthetic peptide"
EPKSSDKTHTCPPCPAPELLGGSS

SEQ ID NO: 319 - protein, 24 aa, Artificial Sequence
  source: /note="Description of Artificial Sequence: Synthetic peptide"
EPKSSGSTHTCPPCPAPELLGGSS

SEQ ID NO: 320 - protein, 19 aa, Artificial Sequence
  source: /note="Description of Artificial Sequence: Synthetic peptide"
DKTHTCPPCPAPELLGGPS

SEQ ID NO: 321 - protein, 19 aa, Artificial Sequence
  source: /note="Description of Artificial Sequence: Synthetic peptide"
DKTHTCPPCPAPELLGGSS

SEQ ID NO: 322 - protein, 350 aa, Artificial Sequence
  source: /note="Description of Artificial Sequence: Synthetic polypeptide"
METDTLLLWVLLLWVPGSTGGVSDVPRDLEVVAATPTSLLISWVPPSDDYGYYRITYGETGGNSPVQEFTVPIGKGTATISGLKPGVDYTITVYAVEFPWPHAGYYHRPISINYRTEIEPKSSGSTHTCPPCPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 13 aa, Artificial Sequence
  source: /note="Description of Artificial Sequence: Synthetic peptide"
  MOD_RES (3)..(11): Any amino acid and this region may encompass 6 to 9 residues
  VARIANT (12)..(12): /replace="His"
  misc_feature (12)..(12): /note="Residue given in the sequence has no preference with respect to the annotation for said position"
  misc_feature (1)..(13): /note="see specification as filed for detailed description of substitutions and preferred embodiments"
SWXXXXXXXXXYG

SEQ ID NO: 324 - protein, 6 aa, Artificial Sequence
  source: /note="Description of Artificial Sequence: Synthetic peptide"
  MOD_RES (2)..(4): Any amino acid
  VARIANT (5)..(5): /replace="Ser"
  misc_feature (5)..(5): /note="Residue given in the sequence has no preference with respect to the annotation for said position"
  misc_feature (1)..(6): /note="see specification as filed for detailed description of substitutions and preferred embodiments"
PXXXGT

SEQ ID NO: 325 - protein, 13 aa, Artificial Sequence
  source: /note="Description of Artificial Sequence: Synthetic peptide"
  VARIANT (2)..(2): /replace="Phe"
  misc_feature (2)..(2): /note="Residue given in the sequence has no preference with respect to the annotation for said position"
  MOD_RES (3)..(3): Any amino acid
  VARIANT (4)..(4): /replace="Phe" or "Trp"
  misc_feature (4)..(4): /note="Residue given in the sequence has no preference with respect to those in the annotations for said position"
  MOD_RES (5)..(6): Any amino acid
  VARIANT (7)..(7): /replace="Ala"
  misc_feature (7)..(7): /note="Residue given in the sequence has no preference with respect to the annotation for said position"
  VARIANT (10)..(10): /replace="Phe"
  misc_feature (10)..(10): /note="Residue given in the sequence has no preference with respect to the annotation for said position"
  misc_feature (1)..(13): /note="see specification as filed for detailed description of substitutions and preferred embodiments"
EYXYXXSGYYHRP

SEQ ID NO: 326 - protein, 20 aa, Artificial Sequence
  source: /note="Description of Artificial Sequence: Synthetic peptide"
METDTLLLWVLLLWVPGSTG

SEQ ID NO: 327 - protein, 86 aa, Artificial Sequence
  source: /note="Description of Artificial Sequence: Synthetic polypeptide"
EVVAATPTSLLISWDAPAVTVRYYRITYGETGGNSPVQEFTVPGSKSTATISGLKPGVDYTITVYAVTGRGDSPASSKPISINYRT

SEQ ID NO: 328 - protein, 157 aa, Artificial Sequence
  source: /note="Description of Artificial Sequence: Synthetic polypeptide"
  MOD_RES (7)..(21): Any amino acid and this region may encompass 1-15, 2-15, 1-10, 2-10, 1-8, 2-8, 1-5, 2-5, 1-4, 2-4, 1-3, 2-3 or 1-2 residues
  MOD_RES (26)..(45): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (54)..(73): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (79)..(98): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (102)..(121): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (131)..(150): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  misc_feature (1)..(157): /note="see specification as filed for detailed description of substitutions and preferred embodiments"
EVVAATXXXXXXXXXXXXXXXSLLIXXXXXXXXXXXXXXXXXXXXYYRITYGEXXXXXXXXXXXXXXXXXXXXQEFTVXXXXXXXXXXXXXXXXXXXXATIXXXXXXXXXXXXXXXXXXXXDYTITVYAVXXXXXXXXXXXXXXXXXXXXISINYRT

SEQ ID NO: 329 - protein, 118 aa, Artificial Sequence
  source: /note="Description of Artificial Sequence: Synthetic polypeptide"
  MOD_RES (13)..(32): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (53)..(72): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  MOD_RES (92)..(111): Any amino acid and this region may encompass 2-20, 2-15, 2-10, 2-8, 5-20, 5-15, 5-10, 5-8, 6-20, 6-15, 6-10, 6-8, 2-7, 5-7 or 6-7 residues
  misc_feature (1)..(118): /note="see specification as filed for detailed description of substitutions and preferred embodiments"
EVVAATPTSLLIXXXXXXXXXXXXXXXXXXXXYYRITYGETGGNSPVQEFTVXXXXXXXXXXXXXXXXXXXXATISGLKPGVDYTITVYAVXXXXXXXXXXXXXXXXXXXXISINYRT

SEQ ID NO: 330 - protein, 82 aa, Artificial Sequence
  source: /note="Description of Artificial Sequence: Synthetic polypeptide"
EVVAATPTSLLISWHSYYEQNSYYRITYGETGGNSPVQEFTVPYSQTTATISGLKPGVDYTITVYAVYGSKYYYPISINYRT

SEQ ID NO: 331 - protein, 8 aa, Artificial Sequence
  source: /note="Description of Artificial Sequence: Synthetic peptide"
HSYYEQNS

SEQ ID NO: 332 - protein, 4 aa, Artificial Sequence
  source: /note="Description of Artificial Sequence: Synthetic peptide"
YSQT

SEQ ID NO: 333 - protein, 7 aa, Artificial Sequence
  source: /note="Description of Artificial Sequence: Synthetic peptide"
YGSKYYY

SEQ ID NO: 334 - protein, 86 aa, Artificial Sequence
  source: /note="Description of Artificial Sequence: Synthetic polypeptide"
EVVAATPTSLLISWPKYDKTGHYYRITYGETGGNSPVQEFTVPTRQTTATISGLKPGVDYTITVYAVSKDDYYPHEHRPISINYRT

SEQ ID NO: 335 - protein, 8 aa, Artificial Sequence
  source: /note="Description of Artificial Sequence: Synthetic peptide"
PKYDKTGH

SEQ ID NO: 336 - protein, 4 aa, Artificial Sequence
  source: /note="Description of Artificial Sequence: Synthetic peptide"
TRQT

SEQ ID NO: 337 - protein, 11 aa, Artificial Sequence
  source: /note="Description of Artificial Sequence: Synthetic peptide"
SKDDYYPHEHR

SEQ ID NO: 338 - protein, 86 aa, Artificial Sequence
  source: /note="Description of Artificial Sequence: Synthetic polypeptide"
EVVAATPTSLLISWSNDGPGLSYYRITYGETGGNSPVQEFTVPSSQTTATISGLKPGVDYTITVYAVSYYTKKAYSAGPISINYRT

SEQ ID NO: 339 - protein, 8 aa, Artificial Sequence
  source: /note="Description of Artificial Sequence: Synthetic peptide"
SNDGPGLS

SEQ ID NO: 340 - protein, 4 aa, Artificial Sequence
  source: /note="Description of Artificial Sequence: Synthetic peptide"
SSQT

SEQ ID NO: 341 - protein, 11 aa, Artificial Sequence
  source: /note="Description of Artificial Sequence: Synthetic peptide"
SYYTKKAYSAG

SEQ ID NO: 342 - protein, 86 aa, Artificial Sequence
  source: /note="Description of Artificial Sequence: Synthetic polypeptide"
EMVAATPTSLLISWEDDSYYSRYYRITYGETGGNSPVQEFTVPSDLYTATISGLKPGVDYTITVYAVTYDVTDLIMHEPISINYRT

SEQ ID NO: 343 - protein, 8 aa, Artificial Sequence
  source: /note="Description of Artificial Sequence: Synthetic peptide"
EDDSYYSR

SEQ ID NO: 344 - protein, 4 aa, Artificial Sequence
  source: /note="Description of Artificial Sequence: Synthetic peptide"
SDLY

SEQ ID NO: 345 - protein, 10 aa, Artificial Sequence
  source: /note="Description of Artificial Sequence: Synthetic peptide"
YDVTDLIMHE

SEQ ID NO: 346 - protein, 86 aa, Artificial Sequence
  source: /note="Description of Artificial Sequence: Synthetic polypeptide"
EVVAATPTSLLISWEDDSYYSRYYRITYGETGGNSPVQEFTVPSDLYTATISGLKPGVDYTITVYAVTYDVTDLIMHEPISINYRT

SEQ ID NO: 347 - protein, 8 aa, Artificial Sequence
  source: /note="Description of Artificial Sequence: Synthetic peptide"
EDDSYYSR

SEQ ID NO: 348 - protein, 4 aa, Artificial Sequence
  source: /note="Description of Artificial Sequence: Synthetic peptide"
SDLY

SEQ ID NO: 349 - protein, 10 aa, Artificial Sequence
  source: /note="Description of Artificial Sequence: Synthetic peptide"
YDVTDLIMHE

SEQ ID NO: 350 - protein, 86 aa, Artificial Sequence
  source: /note="Description of Artificial Sequence: Synthetic polypeptide"
EVVAATPTSLLISWYMDEYDVRYYRITYGETGGNSPVQEFTVPNYYNTATISGLKPGVDYTITVYAVTRIKANNYMYGPISINYRT

SEQ ID NO: 351 - protein, 86 aa, Artificial Sequence
  source: /note="Description of Artificial Sequence: Synthetic polypeptide"
EVVAATPTSLLISWNHLEHVARYYRITYGETGGNSPVQEFTVPEYPTTATISGLKPGVDYTITVYAVTITMLKYPTQSPISINYRT

SEQ ID NO: 352 - protein, 86 aa, Artificial Sequence
  source: /note="Description of Artificial Sequence: Synthetic polypeptide"
EVVAATPTSLLISWGHYRRSGHYYRITYGETGGNSPVQEFTVDPSSYTATISGLKPGVDYTITVYAVSKDDYYPHEHRPISINYRT

SEQ ID NO: 353 - protein, 84 aa, Artificial Sequence
  source: /note="Description of Artificial Sequence: Synthetic polypeptide"
EVVAATPTSLLISWDASHYERRYYRITYGETGGNSPVQEFTVPRYHHTATISGLKPGVDYTITVYAVTQAQEHYQPPISINYRT

SEQ ID NO: 354 - protein, 82 aa, Artificial Sequence
  source: /note="Description of Artificial Sequence: Synthetic polypeptide"
EVVAATPTSLLISWNSYYHSADYYRITYGETGGNSPVQEFTVPYPPTTATISGLKPGVDYTITVYAVYSAKSYYPISINYRT

SEQ ID NO: 355 - protein, 86 aa, Artificial Sequence
  source: /note="Description of Artificial Sequence: Synthetic polypeptide"
EVVAATPTSLLISWSKYSKHGHYYRITYGETGGNSPVQEFTVPSGNATATISGLKPGVDYTITVYAVEDTNDYPHTHRPISINYRT

SEQ ID NO: 356 - protein, 84 aa, Artificial Sequence
  source: /note="Description of Artificial Sequence: Synthetic polypeptide"
EVVAATPTSLLISWHGEPDQTRYYRITYGETGGNSPVQEFTVPPYRRTATISGLKPGVDYTITVYAVTSGYTGHYQPISINYRT

SEQ ID NO: 357 - protein, 86 aa, Artificial Sequence
  source: /note="Description of Artificial Sequence: Synthetic polypeptide"
EVVAATPTSLLISWSKYSKHGHYYRITYGETGGNSPVQEFTVDPSSYTATISGLKPGVDYTITVYAVSKDDYYPHEHRPISINYRT

SEQ ID NO: 358 - protein, 82 aa, Artificial Sequence
  source: /note="Description of Artificial Sequence: Synthetic polypeptide"
EVVAATPTSLLISWYEPYTPIHYYRITYGETGGNSPVQEFTVPGYYGTATISGLKPGVDYTITVYAVYGYYQYTPISINYRT

SEQ ID NO: 359 - protein, 86 aa, Artificial Sequence
  source: /note="Description of Artificial Sequence: Synthetic polypeptide"
EVVAATPTSLLISWSKYSKHGHYYRITYGETGGNSPVQEFTVPSGNATATISGLKPGVDYTITVYAVSDDNKYYHQHRPISINYRT

SEQ ID NO: 360 - protein, 86 aa, Artificial Sequence; identical to SEQ ID NO: 352
  source: /note="Description of Artificial Sequence: Synthetic polypeptide"

SEQ ID NO: 361 - protein, 86 aa, Artificial Sequence; identical to SEQ ID NO: 355
  source: /note="Description of Artificial Sequence: Synthetic polypeptide"

SEQ ID NO: 362 - protein, 82 aa, Artificial Sequence
  source: /note="Description of Artificial Sequence: Synthetic polypeptide"
EVVAATPTSLLISWYEPGASVYYYRITYGETGGNSPVQEFTVPSYYHTATISGLKPGVDYTITVYAVYGYYEYEPISINYRT

SEQ ID NO: 363 - protein, 82 aa, Artificial Sequence
  source: /note="Description of Artificial Sequence: Synthetic polypeptide"
EVVAATPTSLLISWQSYYAHSDYYRITYGETGGNSPVQEFTVPYPPQTATISGLKPGVDYTITVYAVYAGSSYYPISINYRT

SEQ ID NO: 364 - protein, 86 aa, Artificial Sequence; identical to SEQ ID NO: 352
  source: /note="Description of Artificial Sequence: Synthetic polypeptide"

SEQ ID NO: 365 - protein, 82 aa, Artificial Sequence
  source: /note="Description of Artificial Sequence: Synthetic polypeptide"
EVVAATPTSLLISWPEPGTPVYYYRITYGETGGNSPVQEFTVPAYYGTATISGLKPGVDYTITVYAVYGYYDYSPISINYRT

SEQ ID NO: 366 - protein, 86 aa, Artificial Sequence
  source: /note="Description of Artificial Sequence: Synthetic polypeptide"
EVVAATPTSLLISWYRYEKTQHYYRITYGETGGNSPVQEFTVPPESGTATISGLKPGVDYTITVYAVYAGYEYPHTHRPISINYRT

SEQ ID NO: 367 - protein, 87 aa, Artificial Sequence
  source: /note="Description of Artificial Sequence: Synthetic polypeptide"
EVVAATPTSLLISWVKSEEYYRYYRITYGETGGNSPVQEFTVPYYVHTATISGLKPGVDYTITVYAVTEYYYAGAVVSVPISINYRT

SEQ ID NO: 368 - protein, 82 aa, Artificial Sequence
  source: /note="Description of Artificial Sequence: Synthetic polypeptide"
EVVAATPTSLLISWYDPYTYGSYYRITYGETGGNSPVQEFTVGPYTTTATISGLKPGVDYTITVYAVSYYYSTQPISINYRT

SEQ ID NO: 369 - protein, 86 aa, Artificial Sequence; identical to SEQ ID NO: 338
  source: /note="Description of Artificial Sequence: Synthetic polypeptide"

SEQ ID NO: 370 - protein, 82 aa, Artificial Sequence
  source: /note="Description of Artificial Sequence: Synthetic polypeptide"
EVVAATPTSLLISWPDPYYKPDYYRITYGETGGNSPVQEFTVPRDYTTATISGLKPGVDYTITVYAVYSYYGYYPISINYRT

SEQ ID NO: 371 - protein, 10 aa, Artificial Sequence
  source: /note="Description of Artificial Sequence: Synthetic peptide"
MGVSDVPRDL

SEQ ID NO: 372 - protein, 9 aa, Artificial Sequence
  source: /note="Description of Artificial Sequence: Synthetic peptide"
GVSDVPRDL

SEQ ID NO: 373 - protein, 8 aa, Artificial Sequence
  source: /note="Description of Artificial Sequence: Synthetic peptide"
VSDVPRDL

SEQ ID NO: 374 - protein, 7 aa, Artificial Sequence
  source: /note="Description of Artificial Sequence: Synthetic peptide"
SDVPRDL

SEQ ID NO: 375 - protein, 6 aa, Artificial Sequence
  source: /note="Description of Artificial Sequence: Synthetic peptide"
DVPRDL

SEQ ID NO: 376 - protein, 5 aa, Artificial Sequence
  source: /note="Description of Artificial Sequence: Synthetic peptide"
VPRDL

SEQ ID NO: 377 - protein, 4 aa, Artificial Sequence
  source: /note="Description of Artificial Sequence: Synthetic peptide"
PRDL

SEQ ID NO: 378 - protein, 3 aa, Artificial Sequence
  source: /note="Description of Artificial Sequence: Synthetic peptide"
RDL

SEQ ID NO: 379 - protein, 2 aa, Artificial Sequence
  source: /note="Description of Artificial Sequence: Synthetic peptide"
DL

SEQ ID NO: 380 - protein, 7 aa, Artificial Sequence
  source: /note="Description of Artificial Sequence: Synthetic peptide"
EIDKPSQ

SEQ ID NO: 381 - protein, 6 aa, Artificial Sequence
  source: /note="Description of Artificial Sequence: Synthetic peptide"
EIDKPS

SEQ ID NO: 382 - protein, 6 aa, Artificial Sequence
  source: /note="Description of Artificial Sequence: Synthetic peptide"
EIDKPC

SEQ ID NO: 383 - protein, 5 aa, Artificial Sequence
  source: /note="Description of Artificial Sequence: Synthetic peptide"
EIDKP

SEQ ID NO: 384 - protein, 4 aa, Artificial Sequence
  source: /note="Description of Artificial Sequence: Synthetic peptide"
EIDK

SEQ ID NO: 385 - protein, 2 aa, Artificial Sequence
  source: /note="Description of Artificial Sequence: Synthetic peptide"
EI

SEQ ID NO: 386 - protein, 7 aa, Artificial Sequence
  source: /note="Description of Artificial Sequence: Synthetic peptide"
EIEKPSQ

SEQ ID NO: 387 - protein, 9 aa, Artificial Sequence
  source: /note="Description of Artificial Sequence: Synthetic peptide"
EIDKPSQLE

SEQ ID NO: 388 - protein, 12 aa, Artificial Sequence
  source: /note="Description of Artificial Sequence: Synthetic peptide"
EIEDEDEDEDED

SEQ ID NO: 389 - protein, 17 aa, Artificial Sequence
  source: /note="Description of Artificial Sequence: Synthetic peptide"
EIEKPSQEDEDEDEDED

SEQ ID NO: 390 - protein, 5 aa, Artificial Sequence
  source: /note="Description of Artificial Sequence: Synthetic peptide"
EGSGS

SEQ ID NO: 391 - protein, 7 aa, Artificial Sequence
  source: /note="Description of Artificial Sequence: Synthetic peptide"
EIDKPCQ

SEQ ID NO: 392 - protein, 7 aa, Artificial Sequence
  source: /note="Description of Artificial Sequence: Synthetic peptide"
EIEKPCQ

SEQ ID NO: 393 - protein, 4 aa, Artificial Sequence
  source: /note="Description of Artificial Sequence: Synthetic peptide"
GSGC

SEQ ID NO: 394 - protein, 5 aa, Artificial Sequence
  source: /note="Description of Artificial Sequence: Synthetic peptide"
EGSGC

SEQ ID NO: 395 - protein, 9 aa, Artificial Sequence
  source: /note="Description of Artificial Sequence: Synthetic peptide"
EIDKPCQLE

SEQ ID NO: 396 - protein, 5 aa, Artificial Sequence
  source: /note="Description of Artificial Sequence: Synthetic peptide"
GGSGS

SEQ ID NO: 397 - protein, 9 aa, Artificial Sequence
  source: /note="Description of Artificial Sequence: Synthetic peptide"
GGSGSGSGS

SEQ ID NO: 398 - protein, 13 aa, Artificial Sequence
  source: /note="Description of Artificial Sequence: Synthetic peptide"
GGSGSGSGSGSGS

SEQ ID NO: 399 - protein, 15 aa, Artificial Sequence
  source: /note="Description of Artificial Sequence: Synthetic peptide"
GGSGSGSGSGSGSGS

SEQ ID NO: 400 - protein, 16 aa, Artificial Sequence
  source: /note="Description of Artificial Sequence: Synthetic peptide"
GGSGSGSGSGSGSGSG

SEQ ID NO: 401 - protein, 4 aa, Artificial Sequence
  source: /note="Description of Artificial Sequence: Synthetic peptide"
GSGS

SEQ ID NO: 402 - protein, 8 aa, Artificial Sequence
  source: /note="Description of Artificial Sequence: Synthetic peptide"
GSGSGSGS

SEQ ID NO: 403 - protein, 14 aa, Artificial Sequence
  source: /note="Description of Artificial Sequence: Synthetic peptide"
GSGSGSGSGSGSGS

SEQ ID NO: 404 - protein, 13 aa, Artificial Sequence
  source: /note="Description of Artificial Sequence: Synthetic peptide"
GSAAAAAAAAAGS

SEQ ID NO: 405 - protein, 15 aa, Artificial Sequence
  source: /note="Description of Artificial Sequence: Synthetic peptide"
GSEGSEGSEGSEGSE

SEQ ID NO: 406 - protein, 15 aa, Artificial Sequence
  source: /note="Description of Artificial Sequence: Synthetic peptide"
PASPASPASPASPAS

SEQ ID NO: 407 - protein, 15 aa, Artificial Sequence
  source: /note="Description of Artificial Sequence: Synthetic peptide"
GSPGSPGSPGSPGSP

SEQ ID NO: 408 - protein, 14 aa, Artificial Sequence
  source: /note="Description of Artificial Sequence: Synthetic peptide"
GSTVAAPSTVAAPS

SEQ ID NO: 409 - protein, 8 aa, Artificial Sequence
  source: /note="Description of Artificial Sequence: Synthetic peptide"
GGSEGGSE

SEQ ID NO: 410 - protein, 7 aa, Artificial Sequence
  source: /note="Description of Artificial Sequence: Synthetic peptide"
STSTSTG

SEQ ID NO: 411 - protein, 35 aa, Artificial Sequence
  source: /note="Description of Artificial Sequence: Synthetic polypeptide"
GGGGSGGGGSGGGGSGGGGSGGGGSGGGGSGGGGS

SEQ ID NO: 412 - protein, 30 aa, Artificial Sequence
  source: /note="Description of Artificial Sequence: Synthetic polypeptide"
GGGGSGGGGSGGGGSGGGGSGGGGSGGGGS

SEQ ID NO: 413 - protein, 16 aa, Artificial Sequence
  source: /note="Description of Artificial Sequence: Synthetic peptide"
GGGGSGGGGSGGGGSG

SEQ ID NO: 414 - protein, 7 aa, Artificial Sequence
  source: /note="Description of Artificial Sequence: Synthetic peptide"
GPGPGPG

SEQ ID NO: 415 - protein, 11 aa, Artificial Sequence
  source: /note="Description of Artificial Sequence: Synthetic peptide"
GPGPGPGPGPG

SEQ ID NO: 416 - protein, 7 aa, Artificial Sequence
  source: /note="Description of Artificial Sequence: Synthetic peptide"
PSTSTST

SEQ ID NO: 417 - protein, 6 aa, Artificial Sequence
  source: /note="Description of Artificial Sequence: Synthetic peptide"
PAPAPA

SEQ ID NO: 418 - protein, 12 aa, Artificial Sequence
  source: /note="Description of Artificial Sequence: Synthetic peptide"
PAPAPAPAPAPA

SEQ ID NO: 419 - protein, 18 aa, Artificial Sequence
  source: /note="Description of Artificial Sequence: Synthetic peptide"
PAPAPAPAPAPAPAPAPA

SEQ ID NO: 420 - protein, 105 aa, Artificial Sequence
  source: /note="Description of Artificial Sequence: Synthetic polypeptide"
MGVSDVPRDLEVVAATPTSLLISWHSYYEQNSYYRITYGETGGNSPVQEFTVPYSQTTATISGLKPGVDYTITVYAVYGSKYYYPISINYRTEIDKPSQHHHHHH

SEQ ID NO: 421 - protein, 104 aa, Artificial Sequence
  source: /note="Description of Artificial Sequence: Synthetic polypeptide"
MGVSDVPRDLEVVAATPTSLLISWHSYYEQNSYYRITYGETGGNSPVQEFTVPYSQTTATISGLKPGVDYTITVYAVYGSKYYYPISINYRTEIEDEDEDEDED

SEQ ID NO: 422 - protein, 110 aa, Artificial Sequence
  source: /note="Description of Artificial Sequence: Synthetic polypeptide"
MGVSDVPRDLEVVAATPTSLLISWHSYYEQNSYYRITYGETGGNSPVQEFTVPYSQTTATISGLKPGVDYTITVYAVYGSKYYYPISINYRTEIEDEDEDEDEDHHHHHH

SEQ ID NO: 423 - protein, 109 aa, Artificial Sequence
  source: /note="Description of Artificial Sequence: Synthetic polypeptide"
MGVSDVPRDLEVVAATPTSLLISWPKYDKTGHYYRITYGETGGNSPVQEFTVPTRQTTATISGLKPGVDYTITVYAVSKDDYYPHEHRPISINYRTEIDKPSQHHHHHH

SEQ ID NO: 424 - protein, 109 aa, Artificial Sequence
  source: /note="Description of Artificial Sequence: Synthetic polypeptide"
MGVSDVPRDLEVVAATPTSLLISWSNDGPGLSYYRITYGETGGNSPVQEFTVPSSQTTATISGLKPGVDYTITVYAVSYYTKKAYSAGPISINYRTEIDKPSQHHHHHH

SEQ ID NO: 425 - protein, 109 aa, Artificial Sequence
  source: /note="Description of Artificial Sequence: Synthetic polypeptide"
MGVSDVPRDLEMVAATPTSLLISWEDDSYYSRYYRITYGETGGNSPVQEFTVPSDLYTATISGLKPGVDYTITVYAVTYDVTDLIMHEPISINYRTEIDKPSQHHHHHH

SEQ ID NO: 426 - protein, 109 aa, Artificial Sequence
  source: /note="Description of Artificial Sequence: Synthetic polypeptide"
MGVSDVPRDLEVVAATPTSLLISWEDDSYYSRYYRITYGETGGNSPVQEFTVPSDLYTATISGLKPGVDYTITVYAVTYDVTDLIMHEPISINYRTEIDKPSQHHHHHH

SEQ ID NO: 427 - protein, 109 aa, Artificial Sequence
  source: /note="Description of Artificial Sequence: Synthetic polypeptide"
MGVSDVPRDLEVVAATPTSLLISWYMDEYDVRYYRITYGETGGNSPVQEFTVPNYYNTATISGLKPGVDYTITVYAVTRIKANNYMYGPISINYRTEIDKPSQHHHHHH

SEQ ID NO: 428 - protein, 109 aa, Artificial Sequence
  source: /note="Description of Artificial Sequence: Synthetic polypeptide"
MGVSDVPRDLEVVAATPTSLLISWNHLEHVARYYRITYGETGGNSPVQEFTVPEYPTTATISGLKPGVDYTITVYAVTITMLKYPTQSPISINYRTEIDKPSQHHHHHH

SEQ ID NO: 429 - protein, 109 aa, Artificial Sequence
  source: /note="Description of Artificial Sequence: Synthetic polypeptide"
MGVSDVPRDLEVVAATPTSLLISWGHYRRSGHYYRITYGETGGNSPVQEFTVDPSSYTATISGLKPGVDYTITVYAVSKDDYYPHEHRPISINYRTEIDKPSQHHHHHH

SEQ ID NO: 430 - protein, 107 aa, Artificial Sequence
  source: /note="Description of Artificial Sequence: Synthetic polypeptide"
MGVSDVPRDLEVVAATPTSLLISWDASHYERRYYRITYGETGGNSPVQEFTVPRYHHTATISGLKPGVDYTITVYAVTQAQEHYQPPISINYRTEIDKPSQHHHHHH

SEQ ID NO: 431 - protein, 105 aa, Artificial Sequence
  source: /note="Description of Artificial Sequence: Synthetic polypeptide"
MGVSDVPRDLEVVAATPTSLLISWNSYYHSADYYRITYGETGGNSPVQEFTVPYPPTTATISGLKPGVDYTITVYAVYSAKSYYPISINYRTEIDKPSQHHHHHH

SEQ ID NO: 432 - protein, 109 aa, Artificial Sequence
  source: /note="Description of Artificial Sequence: Synthetic polypeptide"
MGVSDVPRDLEVVAATPTSLLISWSKYSKHGHYYRITYGETGGNSPVQEFTVPSGNATATISGLKPGVDYTITVYAVEDTNDYPHTHRPISINYRTEIDKPSQHHHHHH

SEQ ID NO: 433 - protein, 107 aa, Artificial Sequence
  source: /note="Description of Artificial Sequence: Synthetic polypeptide"
MGVSDVPRDLEVVAATPTSLLISWHGEPDQTRYYRITYGETGGNSPVQEFTVPPYRRTATISGLKPGVDYTITVYAVTSGYTGHYQPISINYRTEIDKPSQHHHHHH

SEQ ID NO: 434 - protein, 109 aa, Artificial Sequence
  source: /note="Description of Artificial Sequence: Synthetic polypeptide"
MGVSDVPRDLEVVAATPTSLLISWSKYSKHGHYYRITYGETGGNSPVQEFTVDPSSYTATISGLKPGVDYTITVYAVSKDDYYPHEHRPISINYRTEIDKPSQHHHHHH

SEQ ID NO: 435 - protein, 105 aa, Artificial Sequence
  source: /note="Description of Artificial Sequence: Synthetic polypeptide"
MGVSDVPRDLEVVAATPTSLLISWYEPYTPIHYYRITYGETGGNSPVQEFTVPGYYGTATISGLKPGVDYTITVYAVYGYYQYTPISINYRTEIDKPSQHHHHHH

SEQ ID NO: 436 - protein, 109 aa, Artificial Sequence
  source: /note="Description of Artificial Sequence: Synthetic polypeptide"
MGVSDVPRDLEVVAATPTSLLISWSKYSKHGHYYRITYGETGGNSPVQEFTVPSGNATATISGLKPGVDYTITVYAVSDDNKYYHQHRPISINYRTEIDKPSQHHHHHH

SEQ ID NO: 437 - protein, 109 aa, Artificial Sequence; identical to SEQ ID NO: 429
  source: /note="Description of Artificial Sequence: Synthetic polypeptide"

SEQ ID NO: 438 - protein, 109 aa, Artificial Sequence; identical to SEQ ID NO: 432
  source: /note="Description of Artificial Sequence: Synthetic polypeptide"

SEQ ID NO: 439 - protein, 105 aa, Artificial Sequence
  source: /note="Description of Artificial Sequence: Synthetic polypeptide"
MGVSDVPRDLEVVAATPTSLLISWYEPGASVYYYRITYGETGGNSPVQEFTVPSYYHTATISGLKPGVDYTITVYAVYGYYEYEPISINYRTEIDKPSQHHHHHH

SEQ ID NO: 440 - protein, 105 aa, Artificial Sequence
  source: /note="Description of Artificial Sequence: Synthetic polypeptide"
MGVSDVPRDLEVVAATPTSLLISWQSYYAHSDYYRITYGETGGNSPVQEFTVPYPPQTATISGLKPGVDYTITVYAVYAGSSYYPISINYRTEIDKPSQHHHHHH

SEQ ID NO: 441 - protein, 109 aa, Artificial Sequence; identical to SEQ ID NO: 429
  source: /note="Description of Artificial Sequence: Synthetic polypeptide"

SEQ ID NO: 442 - protein, 105 aa, Artificial Sequence
  source: /note="Description of Artificial Sequence: Synthetic polypeptide"
MGVSDVPRDLEVVAATPTSLLISWPEPGTPVYYYRITYGETGGNSPVQEFTVPAYYGTATISGLKPGVDYTITVYAVYGYYDYSPISINYRTEIDKPSQHHHHHH

SEQ ID NO: 443 - protein, 109 aa, Artificial Sequence
  source: /note="Description of Artificial Sequence: Synthetic polypeptide"
MGVSDVPRDLEVVAATPTSLLISWYRYEKTQHYYRITYGETGGNSPVQEFTVPPESGTATISGLKPGVDYTITVYAVYAGYEYPHTHRPISINYRTEIDKPSQHHHHHH

SEQ ID NO: 444 - protein, 110 aa, Artificial Sequence
  source: /note="Description of Artificial Sequence: Synthetic polypeptide"
MGVSDVPRDLEVVAATPTSLLISWVKSEEYYRYYRITYGETGGNSPVQEFTVPYYVHTATISGLKPGVDYTITVYAVTEYYYAGAVVSVPISINYRTEIDKPSQHHHHHH

SEQ ID NO: 445 - protein, 105 aa, Artificial Sequence
  source: /note="Description of Artificial Sequence: Synthetic polypeptide"
MGVSDVPRDLEVVAATPTSLLISWYDPYTYGSYYRITYGETGGNSPVQEFTVGPYTTTATISGLKPGVDYTITVYAVSYYYSTQPISINYRTEIDKPSQHHHHHH

SEQ ID NO: 446 - protein, 109 aa, Artificial Sequence; identical to SEQ ID NO: 424
  source: /note="Description of Artificial Sequence: Synthetic polypeptide"

SEQ ID NO: 447 - protein, 105 aa, Artificial Sequence
  source: /note="Description of Artificial Sequence: Synthetic polypeptide"
MGVSDVPRDLEVVAATPTSLLISWPDPYYKPDYYRITYGETGGNSPVQEFTVPRDYTTATISGLKPGVDYTITVYAVYSYYGYYPISINYRTEIDKPSQHHHHHH

SEQ ID NO: 448 - protein, 208 aa, Homo sapiens
VFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 11 aa, Artificial Sequence
  source: /note="Description of Artificial Sequence: Synthetic peptide"
  MOD_RES (1)..(9): Any amino acid and this region may encompass 6 to 9 residues
  VARIANT (10)..(10): /replace="His"
  misc_feature (10)..(10): /note="Residue given in the sequence has no preference with respect to the annotation for said position"
  misc_feature (1)..(11): /note="see specification as filed for detailed description of substitutions and preferred embodiments"
XXXXXXXXXYG

SEQ ID NO: 450 - protein, 4 aa, Artificial Sequence
  source: /note="Description of Artificial Sequence: Synthetic peptide"
  MOD_RES (1)..(3): Any amino acid
  VARIANT (4)..(4): /replace="Ser"
  misc_feature (4)..(4): /note="Residue given in the sequence has no preference with respect to the annotation for said position"
  misc_feature (1)..(4): /note="see specification as filed for detailed description of substitutions and preferred embodiments"
XXXG

SEQ ID NO: 451 - protein, 12 aa, Artificial Sequence
  source: /note="Description of Artificial Sequence: Synthetic peptide"
  VARIANT (2)..(2): /replace="Phe"
  misc_feature (2)..(2): /note="Residue given in the sequence has no preference with respect to the annotation for said position"
  MOD_RES (3)..(3): Any amino acid
  VARIANT (4)..(4): /replace="Phe" or "Trp"
  misc_feature (4)..(4): /note="Residue given in the sequence has no preference with respect to those in the annotations for said position"
  MOD_RES (5)..(6): Any amino acid
  VARIANT (7)..(7): /replace="Ala"
  misc_feature (7)..(7): /note="Residue given in the sequence has no preference with respect to the annotation for said position"
  VARIANT (10)..(10): /replace="Phe"
  misc_feature (10)..(10): /note="Residue given in the sequence has no preference with respect to the annotation for said position"
  misc_feature (1)..(12): /note="see specification as filed for detailed description of substitutions and preferred embodiments"
EYXYXXSGYYHR

SEQ ID NO: 452 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWPPPSHGYGYYRITYGETGGNSPVQEFTVPPGKGTATISGLKPGVDYTITVYAVEYPYKHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 453 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWRPPIHAYGYYRITYGETGGNSPVQEFTVPIVEGTATISGLKPGVDYTITVYAVEYTFKHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 454 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPIHAYGYYRITYGETGGNSPVQEFTVPGSEGTATISGLKPGVDYTITVYAVEYTFKHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAHAYGYYRITYGETGGNSPVQEFTVPGSKGTATISGLKPGVDYTITVYAVEYTFKHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 456 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAVTYGYYRITYGETGGNSPVQEFTVPGSKSTATISGLKPGVDYTITVYAVEYTFKHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 457 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWSPPANGYGYYRITYGETGGNSPVQEFTVPVGRGTATISGLKPGVDYTITVYAVEYTYKGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 333 aa, Artificial Sequence [sequence omitted]

SEQ ID NO: 459 - protein, 332 aa, Artificial Sequence [sequence omitted]

SEQ ID NO: 460 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWTPPPKGYGYYRITYGETGGNSPVQEFTVPVGEGTATISGLKPGVDYTITVYAVEYTYEGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 461 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWTPPPKGYGYYRITYGETGGNSPVQEFTVPVGEGTATISGLKPGVDYTITVYAVEYAYNGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWRPPSHAYGYYRITYGETGGNSPVQEFTVPIGKGTATISGLKPGVDYTITVYAVEYPWKGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDPPSHAYGYYRITYGETGGNSPVQEFTVPIGKGTATISGLKPGVDYTITVYAVEYPWKGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 464 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWEPPSHAYGYYRITYGETGGNSPVQEFTVPIGKGTATISGLKPGVDYTITVYAVEYPWKGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 465 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWSPPSHAYGYYRITYGETGGNSPVQEFTVPIGKGTATISGLKPGVDYTITVYAVEYPWKGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 466 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWRPPSNGHGYYRITYGETGGNSPVQEFTVPVNEGTATISGLKPGVDYTITVYAVEFPFKWSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 467 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWVPPSDDYGYYRITYGETGGNSPVQEFTVPIGKGTATISGLKPGVDYTITVYAVEFPWPHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 468 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWVPSSHAYGYYRITYGETGGNSPVQEFTVPVGVGTATISGLKPGVDYTITVYAVEYAFEGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDPSSHAYGYYRITYGETGGNSPVQEFTVPVGVGTATISGLKPGVDYTITVYAVEYAFEGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 470 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWEPSSHAYGYYRITYGETGGNSPVQEFTVPVGVGTATISGLKPGVDYTITVYAVEYAFEGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 471 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYDYSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 472 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYEHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYPHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGGYGYYRITYGETGGNSPVQEFTVPSSKGTATISGLKPGVDYTITVYAVEYTFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 476 - protein, 335 aa, Artificial Sequence
  source: /note="Description of Artificial Sequence: Synthetic polypeptide"
  VARIANT (100)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEFPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGGYGYYRITYGETGGNSPVQEFTVPVSKSTATISGLKPGVDYTITVYAVEYTFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEFPYAHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGDGYGYYRITYGETGGNSPVQEFTVPVSKGTATISGLKPGVDYTITVYAVEFTFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 480 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYAHSGYFHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWAAPAGGGYGYYRITYGETGGNSPVQEFTVPVSKGTATISGLKPGVDYTITVYAVEYDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADAYGYYRITYGETGGNSPVQEFTVPSSKGTATISGLKPGVDYTITVYAVEYDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADAYGYYRITYGETGGNSPVQEFTVPVSKGTATISGLKPGVDYTITVYAVEFDYPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGAYGYYRITYGETGGNSPVQEFTVPVSKGTATISGLKPGVDYTITVYAVEYSFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAEGYGYYRITYGETGGNSPVQEFTVPVSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADEAYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGGYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADGYGYYRITYGETGGNSPVQEFTVPVSKGTATISGLKPGVDYTITVYAVEFPFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAEGYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGGGYGYYRITYGETGGNSPVQEFTVPVSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAADAYGYYRITYGETGGNSPVQEFTVPVSKGTATISGLKPGVDYTITVYAVEFNFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWDAPAEAGKHYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAEAYGYYRITYGETGGNSPVQEFTVPVSKGTATISGLKPGVDYTITVYAVEFTYPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 494 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAAYGYYRITYGETGGNSPVQEFTVPVSKGTATISGLKPGVDYTITVYAVEYDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (100)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGGGYGYYRITYGETGGNSPVQEFTVPSSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 496 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAGGYGYYRITYGETGGNSPVQEFTVPVSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADGYGYYRITYGETGGNSPVQEFTVPVFKGTATISGLKPGVDYTITVYAVEFDYPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 498 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAAGGYGYYRITYGETGGNSPVQEFTVPSSKGTATISGLKPGVDYTITVYAVEYDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 499 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADAYGYYRITYGETGGNSPVQEFTVPGSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 500 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAAYGYYRITYGETGGNSPVQEFTVPSSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 501 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAGYGYYRITYGETGGNSPVQEFTVPVSKGTATISGLKPGVDYTITVYAVEFPFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 502 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAGGYGYYRITYGETGGNSPVQEFTVPSSKGTATISGLKPGVDYTITVYAVEFDYPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 503 - protein, 333 aa, Artificial Sequence; identical to SEQ ID NO: 487
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"

SEQ ID NO: 504 - protein, 334 aa, Artificial Sequence
  source: /note="Description of Artificial Sequence: Synthetic polypeptide"
  VARIANT (99)..(100): /replace=" "
  VARIANT (101)..(101): /replace="Glu" or " "
  VARIANT (102)..(102): /replace=" "
  misc_feature (99)..(102): /note="Residues given in the sequence have no preference with respect to those in the annotations for said positions"
  misc_feature (99)..(102): /note="This region may encompass E, EI, EID, EIDK, EIEK or is absent"
  VARIANT (103)..(104): /replace=" "
  VARIANT (105)..(105): /replace="Glu" or " "
  VARIANT (106)..(106): /replace="Pro" or " "
  VARIANT (107)..(107): /replace="Lys" or " "
  VARIANT (108)..(109): /replace="Ser" or " "
  VARIANT (110)..(110): /replace="Asp" or "Gly"
  VARIANT (111)..(111): /replace="Lys" or "Ser"
  misc_feature (103)..(111): /note="Residues given in the sequence have no preference with respect to those in the annotations for said positions"
  VARIANT (113)..(113): /replace="His"
  VARIANT (114)..(114): /replace="Thr"
  VARIANT (115)..(115): /replace="Cys"
  misc_feature (113)..(115): /note="Residues given in the sequence have no preference with respect to those in the annotations for said positions"
  VARIANT (125)..(125): /replace="Ser"
  misc_feature (125)..(125): /note="Residue given in the sequence has no preference with respect to the annotation for said position"
  misc_feature (103)..(126): /note="This region may encompass the sequences disclosed as SEQ ID NOS 317-321"
  VARIANT (334)..(334): /replace=" "
  misc_feature (334)..(334): /note="Residue given in the sequence has no preference with respect to the annotation for said position"
GVSDVPRDLEVVAATPTSLLISWDAPAGAASYGYYRITYGETGGNSPVQEFTVPVSKGTATISGLKPGVDYTITVYAVEFPFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 505 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAGAYGYYRITYGETGGNSPVQEFTVPVSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 506 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDPPAEGYGYYRITYGETGGNSPVQEFTVPVSKGTATISGLKPGVDYTITVYAVEFNFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAGGYGYYRITYGETGGNSPVQEFTVPSSKGTATISGLKPGVDYTITVYAVEFDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GITDVPRDLEVVAATPTSLLISWNPPDVNYGYYRITYGETGGNSPLQEFTVPVSKGTATISGLKPGVDYTITVYAVEYPYAHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 509 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGDGYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 510 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGGGYGYYRITYGETGGNSPVQEFTVPVSKGTATISGLKPGVDYTITVYAVEFTFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAEGGYGYYRITYGETGGNSPVQEFTVPVSKGTATISGLKPGVDYTITVYAVEFDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 512 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAEAYGYYRITYGETGGNSPVQEFTVPVSKGTATISGLKPGVDYTITVYAVEYDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 513 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWEPFSRLPGGGEYYRITYGETGGNSPLQQFTVPGSKGTATISGLKPGVDYTITVYAVEYPYPFSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 514 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGGYGYYRITYGETGGNSPVQEFTVPGSKGTATISGLKPGVDYTITVYAVEYDFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 515 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGGGYGYYRITYGETGGNSPVQEFTVPVSKGTATISGLKPGVDYTITVYAVEYNFIGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 516 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPADGAYGYYRITYGETGGNSPVQEFTVPVSKGTATISGLKPGVDYTITVYAVEFPYPFAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWSEKLDGKARRGYYRITYGETGGNSPVQQFTVPGSKGTATISGLKPGVDYTITVYAVEFPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 518 - protein, 336 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (336)..(336): /replace=" "
  misc_feature (336)..(336): /note="Residue given in the sequence has no preference with respect to the annotation for said position"
GVSDVPRDLEVVAATPTSLLISWSPRDSTGLVRRGYYRITYGETGGNSPVQQFTVPGSKGTATISGLKPGVDYTITVYAVEYPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 519 - protein, 335 aa, Artificial Sequence
  source: /note="Description of Artificial Sequence: Synthetic polypeptide"
  VARIANT (101)..(101): /replace=" "
  VARIANT (102)..(102): /replace="Glu" or " "
  VARIANT (103)..(103): /replace=" "
  misc_feature (100)..(103): /note="Residues given in the sequence have no preference with respect to those in the annotations for said positions"
  misc_feature (100)..(103): /note="This region may encompass E, EI, EID, EIDK, EIEK or is absent"
  VARIANT (104)..(105): /replace=" "
  VARIANT (106)..(106): /replace="Glu" or " "
  VARIANT (107)..(107): /replace="Pro" or " "
  VARIANT (108)..(108): /replace="Lys" or " "
  VARIANT (109)..(110): /replace="Ser" or " "
  VARIANT (111)..(111): /replace="Asp" or "Gly"
  VARIANT (112)..(112): /replace="Lys" or "Ser"
  misc_feature (104)..(112): /note="Residues given in the sequence have no preference with respect to those in the annotations for said positions"
  VARIANT (114)..(114): /replace="His"
  VARIANT (115)..(115): /replace="Thr"
  VARIANT (116)..(116): /replace="Cys"
  misc_feature (114)..(116): /note="Residues given in the sequence have no preference with respect to those in the annotations for said positions"
  VARIANT (126)..(126): /replace="Ser"
  misc_feature (126)..(126): /note="Residue given in the sequence has no preference with respect to the annotation for said position"
  misc_feature (104)..(127): /note="This region may encompass the sequences disclosed as SEQ ID NOS 317-321"
  VARIANT (335)..(335): /replace=" "
  misc_feature (335)..(335): /note="Residue given in the sequence has no preference with respect to the annotation for said position"
GVSDVPRDLEVVAATPTSLLISWGDVRTNEARQGYYRITYGETGGNSPLQGFTVPGSKGTATISGLKPGVDYTITVYAVEYTYEHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAGGGYGYYRITYGETGGNSPVQEFTVPVSKGTATISGLKPGVDYTITVYAVEFDFVGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAAYGYYRITYGETGGNSPVQEFTVPVSKGTATISGLKPGVDYTITVYAVEYDFAGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADAYGYYRITYGETGGNSPVQEFTVPSSKGTATISGLKPGVDYTITVYAVEFAFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 523 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAGGYGYYRITYGETGGNSPVQEFTVPVSKGTATISGLKPGVDYTITVYAVEYDFAGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 334 aa, Artificial Sequence
  source: /note="Description of Artificial Sequence: Synthetic polypeptide"
  VARIANT (99)..(100): /replace=" "
  VARIANT (101)..(101): /replace="Glu" or " "
  VARIANT (102)..(102): /replace=" "
  misc_feature (99)..(102): /note="Residues given in the sequence have no preference with respect to those in the annotations for said positions"
  misc_feature (99)..(102): /note="This region may encompass E, EI, EID, EIDK, EIEK or is absent"
  VARIANT (103)..(104): /replace=" "
  VARIANT (105)..(105): /replace="Glu" or " "
  VARIANT (106)..(106): /replace="Pro" or " "
  VARIANT (107)..(107): /replace="Lys" or " "
  VARIANT (108)..(109): /replace="Ser" or " "
  VARIANT (110)..(110): /replace="Asp" or "Gly"
  VARIANT (111)..(111): /replace="Lys" or "Ser"
  misc_feature (103)..(111): /note="Residues given in the sequence have no preference with respect to those in the annotations for said positions"
  VARIANT (113)..(113): /replace="His"
  VARIANT (114)..(114): /replace="Thr"
  VARIANT (115)..(115): /replace="Cys"
  misc_feature (113)..(115): /note="Residues given in the sequence have no preference with respect to those in the annotations for said positions"
  VARIANT (125)..(125): /replace="Ser"
  misc_feature (125)..(125): /note="Residue given in the sequence has no preference with respect to the annotation for said position"
  misc_feature (103)..(126): /note="This region may encompass the sequences disclosed as SEQ ID NOS 317-321"
  VARIANT (334)..(334): /replace=" "
  misc_feature (334)..(334): /note="Residue given in the sequence has no preference with respect to the annotation for said position"
GVSDVPRDLEVVAATPTSLLISWDAPAEAEAYGYYRITYGETGGNSPVQEFTVPVSKGTATISGLKPGVDYTITVYAVEYVFPGAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPAEGAYGYYRITYGETGGNSPVQEFTVPVSKGTATISGLKPGVDYTITVYAVEYPYPFAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVTDVPRDMEVVAATPTSLLISWQPPAVTYGYYRITYGETGGNSTLQQFTVPVYKGTATISGLKPGVDYTITVYAVEYPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 527 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (99)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAAYGYYRITYGETGGNSPVQEFTVPVSKGTATISGLKPGVDYTITVYAVEFDYPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GIVDVPRDLEVVAATPTSLLISWDPPAGAYGYYRITYGETGGNSPKQQFTVPGYKGTATISGLKPGVDYTITVYAVEYPYDHSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 529 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPAAGYGYYRITYGETGGNSPVQEFTVPVSKGTATISGLKPGVDYTITVYAVEYDFPGSGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWAPPSDAYGYYRITYGETGGNSPVQEFTVPIGKGTATISGLKPGVDYTITVYAVEYPYSHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDPPSDDYGYYRITYGETGGNSPVQEFTVPIGKGTATISGLKPGVDYTITVYAVEFPWPHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 532 - protein, 332 aa, Artificial Sequence
  source: /note="Description of Artificial Sequence: Synthetic polypeptide"
  VARIANT (97)..(98): /replace=" "
  VARIANT (99)..(99): /replace="Glu" or " "
  VARIANT (100)..(100): /replace=" "
  misc_feature (97)..(100): /note="Residues given in the sequence have no preference with respect to those in the annotations for said positions"
  misc_feature (97)..(100): /note="This region may encompass E, EI, EID, EIDK, EIEK or is absent"
  VARIANT (101)..(102): /replace=" "
  VARIANT (103)..(103): /replace="Glu" or " "
  VARIANT (104)..(104): /replace="Pro" or " "
  VARIANT (105)..(105): /replace="Lys" or " "
  VARIANT (106)..(107): /replace="Ser" or " "
  VARIANT (108)..(108): /replace="Asp" or "Gly"
  VARIANT (109)..(109): /replace="Lys" or "Ser"
  misc_feature (101)..(109): /note="Residues given in the sequence have no preference with respect to those in the annotations for said positions"
  VARIANT (111)..(111): /replace="His"
  VARIANT (112)..(112): /replace="Thr"
  VARIANT (113)..(113): /replace="Cys"
  misc_feature (111)..(113): /note="Residues given in the sequence have no preference with respect to those in the annotations for said positions"
  VARIANT (123)..(123): /replace="Ser"
  misc_feature (123)..(123): /note="Residue given in the sequence has no preference with respect to the annotation for said position"
  misc_feature (101)..(124): /note="This region may encompass the sequences disclosed as SEQ ID NOS 317-321"
  VARIANT (332)..(332): /replace=" "
  misc_feature (332)..(332): /note="Residue given in the sequence has no preference with respect to the annotation for said position"
GVSDVPRDLEVVAATPTSLLISWDAPADDYGYYRITYGETGGNSPVQEFTVPIGKGTATISGLKPGVDYTITVYAVEFPWPHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 333 aa, Artificial Sequence
  source: /note="Description of Artificial Sequence: Synthetic polypeptide"
  VARIANT (98)..(99): /replace=" "
  VARIANT (100)..(100): /replace="Glu" or " "
  VARIANT (101)..(101): /replace=" "
  misc_feature (98)..(101): /note="Residues given in the sequence have no preference with respect to those in the annotations for said positions"
  misc_feature (98)..(101): /note="This region may encompass E, EI, EID, EIDK, EIEK or is absent"
  VARIANT (102)..(103): /replace=" "
  VARIANT (104)..(104): /replace="Glu" or " "
  VARIANT (105)..(105): /replace="Pro" or " "
  VARIANT (106)..(106): /replace="Lys" or " "
  VARIANT (107)..(108): /replace="Ser" or " "
  VARIANT (109)..(109): /replace="Asp" or "Gly"
  VARIANT (110)..(110): /replace="Lys" or "Ser"
  misc_feature (102)..(110): /note="Residues given in the sequence have no preference with respect to those in the annotations for said positions"
  VARIANT (112)..(112): /replace="His"
  VARIANT (113)..(113): /replace="Thr"
  VARIANT (114)..(114): /replace="Cys"
  misc_feature (112)..(114): /note="Residues given in the sequence have no preference with respect to those in the annotations for said positions"
  VARIANT (124)..(124): /replace="Ser"
  misc_feature (124)..(124): /note="Residue given in the sequence has no preference with respect to the annotation for said position"
  misc_feature (102)..(125): /note="This region may encompass the sequences disclosed as SEQ ID NOS 317-321"
  VARIANT (333)..(333): /replace=" "
  misc_feature (333)..(333): /note="Residue given in the sequence has no preference with respect to the annotation for said position"
GVSDVPRDLEVVAATPTSLLISWDAPSDDYGYYRITYGETGGNSPVQEFTVPIGKGTATISGLKPGVDYTITVYAVEFPWPHAGYYHRPISINYRTEIDKEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 534 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWPPPSHGYGYYRITYGETGGNSPVQEFTVPPGKGTATISGLKPGVDYTITVYAVEYPYKHSGYYHRPISINYRTEIEKPSQEDEDEDEDED

SEQ ID NO: 535 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWRPPIHAYGYYRITYGETGGNSPVQEFTVPIVEGTATISGLKPGVDYTITVYAVEYTFKHSGYYHRPISINYRTEIEKPSQEDEDEDEDED

SEQ ID NO: 536 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPIHAYGYYRITYGETGGNSPVQEFTVPGSEGTATISGLKPGVDYTITVYAVEYTFKHSGYYHRPISINYRTEIEKPSQEDEDEDEDED

SEQ ID NO: 537 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAHAYGYYRITYGETGGNSPVQEFTVPGSKGTATISGLKPGVDYTITVYAVEYTFKHSGYYHRPISINYRTEIEKPSQEDEDEDEDED

SEQ ID NO: 538 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAVTYGYYRITYGETGGNSPVQEFTVPGSKSTATISGLKPGVDYTITVYAVEYTFKHSGYYHRPISINYRTEIEKPSQEDEDEDEDED

SEQ ID NO: 539 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWSPPANGYGYYRITYGETGGNSPVQEFTVPVGRGTATISGLKPGVDYTITVYAVEYTYKGSGYYHRPISINYRTEIEKPSQEDEDEDEDED

SEQ ID NO: 540 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWTPPPKGYGYYRITYGETGGNSPVQEFTVPVGEGTATISGLKPGVDYTITVYAVEYTYNGAGYYHRPISINYRTEIEKPSQEDEDEDEDED

SEQ ID NO: 541 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWTPPPKGYGYYRITYGETGGNSPVQEFTVPVGEGTATISGLKPGVDYTITVYAVEYTYIGAGYYHRPISINYRTEIEKPSQEDEDEDEDED

SEQ ID NO: 542 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWTPPPKGYGYYRITYGETGGNSPVQEFTVPVGEGTATISGLKPGVDYTITVYAVEYTYEGAGYYHRPISINYRTEIEKPSQEDEDEDEDED

SEQ ID NO: 543 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWTPPPKGYGYYRITYGETGGNSPVQEFTVPVGEGTATISGLKPGVDYTITVYAVEYAYNGAGYYHRPISINYRTEIEKPSQEDEDEDEDED

SEQ ID NO: 544 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWRPPSHAYGYYRITYGETGGNSPVQEFTVPIGKGTATISGLKPGVDYTITVYAVEYPWKGSGYYHRPISINYRTEIEKPSQEDEDEDEDED

SEQ ID NO: 545 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDPPSHAYGYYRITYGETGGNSPVQEFTVPIGKGTATISGLKPGVDYTITVYAVEYPWKGSGYYHRPISINYRTEIEKPSQEDEDEDEDED

SEQ ID NO: 546 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPPSHAYGYYRITYGETGGNSPVQEFTVPIGKGTATISGLKPGVDYTITVYAVEYPWKGSGYYHRPISINYRTEIEKPSQEDEDEDEDED

SEQ ID NO: 547 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWSPPSHAYGYYRITYGETGGNSPVQEFTVPIGKGTATISGLKPGVDYTITVYAVEYPWKGSGYYHRPISINYRTEIEKPSQEDEDEDEDED

SEQ ID NO: 548 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWRPPSNGHGYYRITYGETGGNSPVQEFTVPVNEGTATISGLKPGVDYTITVYAVEFPFKWSGYYHRPISINYRTEIEKPSQEDEDEDEDED

SEQ ID NO: 549 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWVPPSDDYGYYRITYGETGGNSPVQEFTVPIGKGTATISGLKPGVDYTITVYAVEFPWPHAGYYHRPISINYRTEIEKPSQEDEDEDEDED

SEQ ID NO: 550 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWVPSSHAYGYYRITYGETGGNSPVQEFTVPVGVGTATISGLKPGVDYTITVYAVEYAFEGAGYYHRPISINYRTEIEKPSQEDEDEDEDED

SEQ ID NO: 551 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDPSSHAYGYYRITYGETGGNSPVQEFTVPVGVGTATISGLKPGVDYTITVYAVEYAFEGAGYYHRPISINYRTEIEKPSQEDEDEDEDED

SEQ ID NO: 552 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPSSHAYGYYRITYGETGGNSPVQEFTVPVGVGTATISGLKPGVDYTITVYAVEYAFEGAGYYHRPISINYRTEIEKPSQEDEDEDEDED

SEQ ID NO: 553 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYDYSGYYHRPISINYRTEIEKPSQEDEDEDEDED

SEQ ID NO: 554 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYEHSGYYHRPISINYRTEIEKPSQEDEDEDEDED

SEQ ID NO: 555 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYPHSGYYHRPISINYRTEIEKPSQEDEDEDEDED

SEQ ID NO: 556 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGGYGYYRITYGETGGNSPVQEFTVPSSKGTATISGLKPGVDYTITVYAVEYTFPGAGYYHRPISINYRTEIEKPSQEDEDEDEDED

SEQ ID NO: 557 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYDHSGYYHRPISINYRTEIEKPSQEDEDEDEDED

SEQ ID NO: 558 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEFPYDHSGYYHRPISINYRTEIEKPSQEDEDEDEDED

SEQ ID NO: 559 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGGYGYYRITYGETGGNSPVQEFTVPVSKSTATISGLKPGVDYTITVYAVEYTFPGAGYYHRPISINYRTEIEKPSQEDEDEDEDED

SEQ ID NO: 560 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEFPYAHSGYYHRPISINYRTEIEKPSQEDEDEDEDED

SEQ ID NO: 561 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGDGYGYYRITYGETGGNSPVQEFTVPVSKGTATISGLKPGVDYTITVYAVEFTFPGAGYYHRPISINYRTEIEKPSQEDEDEDEDED

SEQ ID NO: 562 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYAHSGYFHRPISINYRTEIEKPSQEDEDEDEDED

SEQ ID NO: 563 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWAAPAGGGYGYYRITYGETGGNSPVQEFTVPVSKGTATISGLKPGVDYTITVYAVEYDFPGAGYYHRPISINYRTEIEKPSQEDEDEDEDED

SEQ ID NO: 564 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADAYGYYRITYGETGGNSPVQEFTVPSSKGTATISGLKPGVDYTITVYAVEYDFPGSGYYHRPISINYRTEIEKPSQEDEDEDEDED

SEQ ID NO: 565 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADAYGYYRITYGETGGNSPVQEFTVPVSKGTATISGLKPGVDYTITVYAVEFDYPGSGYYHRPISINYRTEIEKPSQEDEDEDEDED

SEQ ID NO: 566 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGAYGYYRITYGETGGNSPVQEFTVPVSKGTATISGLKPGVDYTITVYAVEYSFPGAGYYHRPISINYRTEIEKPSQEDEDEDEDED

SEQ ID NO: 567 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEGYGYYRITYGETGGNSPVQEFTVPVSKGTATISGLKPGVDYTITVYAVEFDFPGSGYYHRPISINYRTEIEKPSQEDEDEDEDED

SEQ ID NO: 568 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADEAYGYYRITYGETGGNSPVQEFTVPVSKGTATISGLKPGVDYTITVYAVEFDFPGAGYYHRPISINYRTEIEKPSQEDEDEDEDED

SEQ ID NO: 569 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGGYGYYRITYGETGGNSPVQEFTVPVSKGTATISGLKPGVDYTITVYAVEFDFPGAGYYHRPISINYRTEIEKPSQEDEDEDEDED

SEQ ID NO: 570 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGYGYYRITYGETGGNSPVQEFTVPVSKGTATISGLKPGVDYTITVYAVEFPFPGSGYYHRPISINYRTEIEKPSQEDEDEDEDED

SEQ ID NO: 571 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEGYGYYRITYGETGGNSPVQEFTVPVSKGTATISGLKPGVDYTITVYAVEFDFPGAGYYHRPISINYRTEIEKPSQEDEDEDEDED

SEQ ID NO: 572 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGGYGYYRITYGETGGNSPVQEFTVPVSKGTATISGLKPGVDYTITVYAVEFDFPGSGYYHRPISINYRTEIEKPSQEDEDEDEDED

SEQ ID NO: 573 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAADAYGYYRITYGETGGNSPVQEFTVPVSKGTATISGLKPGVDYTITVYAVEFNFPGAGYYHRPISINYRTEIEKPSQEDEDEDEDED

SEQ ID NO: 574 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEAGKHYGYYRITYGETGGNSPVQEFTVPVSKGTATISGLKPGVDYTITVYAVEFDFPGAGYYHRPISINYRTEIEKPSQEDEDEDEDED

SEQ ID NO: 575 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEAYGYYRITYGETGGNSPVQEFTVPVSKGTATISGLKPGVDYTITVYAVEFTYPGSGYYHRPISINYRTEIEKPSQEDEDEDEDED

SEQ ID NO: 576 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAAYGYYRITYGETGGNSPVQEFTVPVSKGTATISGLKPGVDYTITVYAVEYDFPGSGYYHRPISINYRTEIEKPSQEDEDEDEDED

SEQ ID NO: 577 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGGYGYYRITYGETGGNSPVQEFTVPSSKGTATISGLKPGVDYTITVYAVEFDFPGAGYYHRPISINYRTEIEKPSQEDEDEDEDED

SEQ ID NO: 578 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGYGYYRITYGETGGNSPVQEFTVPVSKGTATISGLKPGVDYTITVYAVEFDFPGSGYYHRPISINYRTEIEKPSQEDEDEDEDED

SEQ ID NO: 579 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGYGYYRITYGETGGNSPVQEFTVPVFKGTATISGLKPGVDYTITVYAVEFDYPGSGYYHRPISINYRTEIEKPSQEDEDEDEDED

SEQ ID NO: 580 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAGGYGYYRITYGETGGNSPVQEFTVPSSKGTATISGLKPGVDYTITVYAVEYDFPGAGYYHRPISINYRTEIEKPSQEDEDEDEDED

SEQ ID NO: 581 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADAYGYYRITYGETGGNSPVQEFTVPGSKGTATISGLKPGVDYTITVYAVEFDFPGSGYYHRPISINYRTEIEKPSQEDEDEDEDED

SEQ ID NO: 582 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAAYGYYRITYGETGGNSPVQEFTVPSSKGTATISGLKPGVDYTITVYAVEFDFPGSGYYHRPISINYRTEIEKPSQEDEDEDEDED

SEQ ID NO: 583 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAGYGYYRITYGETGGNSPVQEFTVPVSKGTATISGLKPGVDYTITVYAVEFPFPGSGYYHRPISINYRTEIEKPSQEDEDEDEDED

SEQ ID NO: 584 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGYGYYRITYGETGGNSPVQEFTVPSSKGTATISGLKPGVDYTITVYAVEFDYPGSGYYHRPISINYRTEIEKPSQEDEDEDEDED

SEQ ID NO: 585 - protein, 363 aa, Artificial Sequence; identical to SEQ ID NO: 569
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"

SEQ ID NO: 586 - protein, 364 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (348)..(348): /replace="Gly" or " "
  VARIANT (349)..(349): /replace="Gly" or "Ser" or " "
  VARIANT (350)..(350): /replace="Asp" or "Ser" or "Gly" or " "
  VARIANT (351)..(351): /replace="Asp" or "Gly" or "Cys" or " "
  VARIANT (352)..(352): /replace="Glu" or "Ser" or "Cys" or " "
  VARIANT (353)..(353): /replace="Cys" or "Asp" or " "
  VARIANT (354)..(354): /replace="Glu" or " "
  VARIANT (355)..(355): /replace="Leu" or "Asp" or " "
  VARIANT (356)..(356): /replace="Glu" or " "
  VARIANT (357)..(357): /replace="Asp" or " "
  VARIANT (358)..(358): /replace="Glu" or " "
  VARIANT (359)..(359): /replace="Asp" or " "
  VARIANT (360)..(364): /replace=" "
  misc_feature (348)..(364): /note="Residues given in the sequence have no preference with respect to those in the annotations for said positions"
  misc_feature (348)..(364): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGAASYGYYRITYGETGGNSPVQEFTVPVSKGTATISGLKPGVDYTITVYAVEFPFPGAGYYHRPISINYRTEIEKPSQEDEDEDEDED

SEQ ID NO: 587 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGAYGYYRITYGETGGNSPVQEFTVPVSKGTATISGLKPGVDYTITVYAVEFDFPGSGYYHRPISINYRTEIEKPSQEDEDEDEDED

SEQ ID NO: 588 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDPPAEGYGYYRITYGETGGNSPVQEFTVPVSKGTATISGLKPGVDYTITVYAVEFNFPGSGYYHRPISINYRTEIEKPSQEDEDEDEDED

SEQ ID NO: 589 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGYGYYRITYGETGGNSPVQEFTVPSSKGTATISGLKPGVDYTITVYAVEFDFPGSGYYHRPISINYRTEIEKPSQEDEDEDEDED

SEQ ID NO: 590 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGITDVPRDLEVVAATPTSLLISWNPPDVNYGYYRITYGETGGNSPLQEFTVPVSKGTATISGLKPGVDYTITVYAVEYPYAHAGYYHRPISINYRTEIEKPSQEDEDEDEDED

SEQ ID NO: 591 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGDGYGYYRITYGETGGNSPVQEFTVPVSKGTATISGLKPGVDYTITVYAVEFDFPGAGYYHRPISINYRTEIEKPSQEDEDEDEDED

SEQ ID NO: 592 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGGYGYYRITYGETGGNSPVQEFTVPVSKGTATISGLKPGVDYTITVYAVEFTFPGAGYYHRPISINYRTEIEKPSQEDEDEDEDED

SEQ ID NO: 593 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEGGYGYYRITYGETGGNSPVQEFTVPVSKGTATISGLKPGVDYTITVYAVEFDFPGAGYYHRPISINYRTEIEKPSQEDEDEDEDED

SEQ ID NO: 594 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEAYGYYRITYGETGGNSPVQEFTVPVSKGTATISGLKPGVDYTITVYAVEYDFPGSGYYHRPISINYRTEIEKPSQEDEDEDEDED

SEQ ID NO: 595 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWEPFSRLPGGGEYYRITYGETGGNSPLQQFTVPGSKGTATISGLKPGVDYTITVYAVEYPYPFSGYYHRPISINYRTEIEKPSQEDEDEDEDED

SEQ ID NO: 596 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGGYGYYRITYGETGGNSPVQEFTVPGSKGTATISGLKPGVDYTITVYAVEYDFPGAGYYHRPISINYRTEIEKPSQEDEDEDEDED

SEQ ID NO: 597 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGGYGYYRITYGETGGNSPVQEFTVPVSKGTATISGLKPGVDYTITVYAVEYNFIGAGYYHRPISINYRTEIEKPSQEDEDEDEDED

SEQ ID NO: 598 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADGAYGYYRITYGETGGNSPVQEFTVPVSKGTATISGLKPGVDYTITVYAVEFPYPFAGYYHRPISINYRTEIEKPSQEDEDEDEDED

SEQ ID NO: 599 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWSEKLDGKARRGYYRITYGETGGNSPVQQFTVPGSKGTATISGLKPGVDYTITVYAVEFPYDHSGYYHRPISINYRTEIEKPSQEDEDEDEDED

SEQ ID NO: 600 - protein, 366 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (350)..(350): /replace="Gly" or " "
  VARIANT (351)..(351): /replace="Gly" or "Ser" or " "
  VARIANT (352)..(352): /replace="Asp" or "Ser" or "Gly" or " "
  VARIANT (353)..(353): /replace="Asp" or "Gly" or "Cys" or " "
  VARIANT (354)..(354): /replace="Glu" or "Ser" or "Cys" or " "
  VARIANT (355)..(355): /replace="Cys" or "Asp" or " "
  VARIANT (356)..(356): /replace="Glu" or " "
  VARIANT (357)..(357): /replace="Leu" or "Asp" or " "
  VARIANT (358)..(358): /replace="Glu" or " "
  VARIANT (359)..(359): /replace="Asp" or " "
  VARIANT (360)..(360): /replace="Glu" or " "
  VARIANT (361)..(361): /replace="Asp" or " "
  VARIANT (362)..(366): /replace=" "
  misc_feature (350)..(366): /note="Residues given in the sequence have no preference with respect to those in the annotations for said positions"
  misc_feature (350)..(366): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWSPRDSTGLVRRGYYRITYGETGGNSPVQQFTVPGSKGTATISGLKPGVDYTITVYAVEYPYDHSGYYHRPISINYRTEIEKPSQEDEDEDEDED

SEQ ID NO: 601 - protein, 365 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (349)..(349): /replace="Gly" or " "
  VARIANT (350)..(350): /replace="Gly" or "Ser" or " "
  VARIANT (351)..(351): /replace="Asp" or "Ser" or "Gly" or " "
  VARIANT (352)..(352): /replace="Asp" or "Gly" or "Cys" or " "
  VARIANT (353)..(353): /replace="Glu" or "Ser" or "Cys" or " "
  VARIANT (354)..(354): /replace="Cys" or "Asp" or " "
  VARIANT (355)..(355): /replace="Glu" or " "
  VARIANT (356)..(356): /replace="Leu" or "Asp" or " "
  VARIANT (357)..(357): /replace="Glu" or " "
  VARIANT (358)..(358): /replace="Asp" or " "
  VARIANT (359)..(359): /replace="Glu" or " "
  VARIANT (360)..(360): /replace="Asp" or " "
  VARIANT (361)..(365): /replace=" "
  misc_feature (349)..(365): /note="Residues given in the sequence have no preference with respect to those in the annotations for said positions"
  misc_feature (349)..(365): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWGDVRTNEARQGYYRITYGETGGNSPLQGFTVPGSKGTATISGLKPGVDYTITVYAVEYTYEHSGYYHRPISINYRTEIEKPSQEDEDEDEDED

SEQ ID NO: 602 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGGYGYYRITYGETGGNSPVQEFTVPVSKGTATISGLKPGVDYTITVYAVEFDFVGAGYYHRPISINYRTEIEKPSQEDEDEDEDED

SEQ ID NO: 603 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAAYGYYRITYGETGGNSPVQEFTVPVSKGTATISGLKPGVDYTITVYAVEYDFAGSGYYHRPISINYRTEIEKPSQEDEDEDEDED

SEQ ID NO: 604 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADAYGYYRITYGETGGNSPVQEFTVPSSKGTATISGLKPGVDYTITVYAVEFAFPGAGYYHRPISINYRTEIEKPSQEDEDEDEDED

SEQ ID NO: 605 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAGGYGYYRITYGETGGNSPVQEFTVPVSKGTATISGLKPGVDYTITVYAVEYDFAGSGYYHRPISINYRTEIEKPSQEDEDEDEDED

SEQ ID NO: 606 - protein, 364 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (348)..(348): /replace="Gly" or " "
  VARIANT (349)..(349): /replace="Gly" or "Ser" or " "
  VARIANT (350)..(350): /replace="Asp" or "Ser" or "Gly" or " "
  VARIANT (351)..(351): /replace="Asp" or "Gly" or "Cys" or " "
  VARIANT (352)..(352): /replace="Glu" or "Ser" or "Cys" or " "
  VARIANT (353)..(353): /replace="Cys" or "Asp" or " "
  VARIANT (354)..(354): /replace="Glu" or " "
  VARIANT (355)..(355): /replace="Leu" or "Asp" or " "
  VARIANT (356)..(356): /replace="Glu" or " "
  VARIANT (357)..(357): /replace="Asp" or " "
  VARIANT (358)..(358): /replace="Glu" or " "
  VARIANT (359)..(359): /replace="Asp" or " "
  VARIANT (360)..(364): /replace=" "
  misc_feature (348)..(364): /note="Residues given in the sequence have no preference with respect to those in the annotations for said positions"
  misc_feature (348)..(364): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEAEAYGYYRITYGETGGNSPVQEFTVPVSKGTATISGLKPGVDYTITVYAVEYVFPGAGYYHRPISINYRTEIEKPSQEDEDEDEDED

SEQ ID NO: 607 - protein, 363 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (347)..(347): /replace="Gly" or " "
  VARIANT (348)..(348): /replace="Gly" or "Ser" or " "
  VARIANT (349)..(349): /replace="Asp" or "Ser" or "Gly" or " "
  VARIANT (350)..(350): /replace="Asp" or "Gly" or "Cys" or " "
  VARIANT (351)..(351): /replace="Glu" or "Ser" or "Cys" or " "
  VARIANT (352)..(352): /replace="Cys" or "Asp" or " "
  VARIANT (353)..(353): /replace="Glu" or " "
  VARIANT (354)..(354): /replace="Leu" or "Asp" or " "
  VARIANT (355)..(355): /replace="Glu" or " "
  VARIANT (356)..(356): /replace="Asp" or " "
  VARIANT (357)..(357): /replace="Glu" or " "
  VARIANT (358)..(358): /replace="Asp" or " "
  VARIANT (359)..(363): /replace=" "
  misc_feature (347)..(363): /note="Residues given in the sequence have no preference with respect to those in the annotations for said positions"
  misc_feature (347)..(363): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAEGAYGYYRITYGETGGNSPVQEFTVPVSKGTATISGLKPGVDYTITVYAVEYPYPFAGYYHRPISINYRTEIEKPSQEDEDEDEDED

SEQ ID NO: 608 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVTDVPRDMEVVAATPTSLLISWQPPAVTYGYYRITYGETGGNSTLQQFTVPVYKGTATISGLKPGVDYTITVYAVEYPYDHSGYYHRPISINYRTEIEKPSQEDEDEDEDED

SEQ ID NO: 609 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAAYGYYRITYGETGGNSPVQEFTVPVSKGTATISGLKPGVDYTITVYAVEFDYPGSGYYHRPISINYRTEIEKPSQEDEDEDEDED

SEQ ID NO: 610 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGIVDVPRDLEVVAATPTSLLISWDPPAGAYGYYRITYGETGGNSPKQQFTVPGYKGTATISGLKPGVDYTITVYAVEYPYDHSGYYHRPISINYRTEIEKPSQEDEDEDEDED

SEQ ID NO: 611 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPAAGYGYYRITYGETGGNSPVQEFTVPVSKGTATISGLKPGVDYTITVYAVEYDFPGSGYYHRPISINYRTEIEKPSQEDEDEDEDED

SEQ ID NO: 612 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWAPPSDAYGYYRITYGETGGNSPVQEFTVPIGKGTATISGLKPGVDYTITVYAVEYPYSHAGYYHRPISINYRTEIEKPSQEDEDEDEDED

SEQ ID NO: 613 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDPPSDDYGYYRITYGETGGNSPVQEFTVPIGKGTATISGLKPGVDYTITVYAVEFPWPHAGYYHRPISINYRTEIEKPSQEDEDEDEDED

SEQ ID NO: 614 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPADDYGYYRITYGETGGNSPVQEFTVPIGKGTATISGLKPGVDYTITVYAVEFPWPHAGYYHRPISINYRTEIEKPSQEDEDEDEDED

SEQ ID NO: 615 - protein, 362 aa, Artificial Sequence
  source: /note="Description of Artificial Sequence: Synthetic polypeptide"
  VARIANT (1)..(2): /replace=" "
  VARIANT (3)..(3): /replace="Glu" or " "
  VARIANT (4)..(4): /replace="Pro" or " "
  VARIANT (5)..(5): /replace="Lys" or " "
  VARIANT (6)..(7): /replace="Ser" or " "
  VARIANT (8)..(8): /replace="Asp" or "Gly"
  VARIANT (9)..(9): /replace="Lys" or "Ser"
  misc_feature (1)..(9): /note="Residues given in the sequence have no preference with respect to those in the annotations for said positions"
  VARIANT (11)..(11): /replace="His"
  VARIANT (12)..(12): /replace="Thr"
  VARIANT (13)..(13): /replace="Cys"
  misc_feature (11)..(13): /note="Residues given in the sequence have no preference with respect to those in the annotations for said positions"
  VARIANT (23)..(23): /replace="Ser"
  misc_feature (23)..(23): /note="Residue given in the sequence has no preference with respect to the annotation for said position"
  misc_feature (1)..(24): /note="This region may encompass the sequences disclosed as SEQ ID NOS 317-321"
  VARIANT (232)..(232): /replace="Ala" or "Gly" or "Gln" or "Glu" or "Thr"
  VARIANT (233)..(233): /replace="Gly" or "Ser" or "Pro" or "Leu" or "Val" or "Ala" or "Gln" or "Thr"
  VARIANT (234)..(234): /replace="Gly" or "Asp" or "Gln" or "Ala" or "Ser" or "Pro" or "Val"
  VARIANT (235)..(235): /replace="Gly" or "Ser" or "Glu" or "Leu" or "Ala" or "Asp"
  VARIANT (236)..(236): /replace="Gly" or "Pro" or "Glu" or "Ser" or "Ala"
  VARIANT (237)..(237): /replace="Ser" or "Gly" or "Pro"
  VARIANT (238)..(238): /replace="Gly" or "Ser" or " "
  VARIANT (239)..(239): /replace="Ala" or "Gly" or " "
  VARIANT (240)..(240): /replace="Gly" or "Ser" or " "
  VARIANT (241)..(241): /replace="Ser" or "Glu" or "Gly" or " "
  VARIANT (242)..(242): /replace="Gly" or "Ala" or "Ser" or " "
  VARIANT (243)..(243): /replace="Ser" or "Gln" or "Gly" or " "
  VARIANT (244)..(244): /replace="Asp" or "Ser" or "Gly" or " "
  VARIANT (245)..(245): /replace="Gly" or " "
  VARIANT (246)..(246): /replace="Glu" or " "
  VARIANT (247)..(247): /replace="Leu" or " "
  VARIANT (248)..(248): /replace="Asp" or " "
  VARIANT (249)..(249): /replace="Gly" or " "
  VARIANT (250)..(250): /replace=" "
  misc_feature (232)..(250): /note="Residues given in the sequence have no preference with respect to those in the annotations for said positions"
  misc_feature (232)..(250): /note="This region may encompass the sequences disclosed as SEQ ID NOS 310-314 or 620-634"
  VARIANT (346)..(346): /replace="Gly" or " "
  VARIANT (347)..(347): /replace="Gly" or "Ser" or " "
  VARIANT (348)..(348): /replace="Asp" or "Ser" or "Gly" or " "
  VARIANT (349)..(349): /replace="Asp" or "Gly" or "Cys" or " "
  VARIANT (350)..(350): /replace="Glu" or "Ser" or "Cys" or " "
  VARIANT (351)..(351): /replace="Cys" or "Asp" or " "
  VARIANT (352)..(352): /replace="Glu" or " "
  VARIANT (353)..(353): /replace="Leu" or "Asp" or " "
  VARIANT (354)..(354): /replace="Glu" or " "
  VARIANT (355)..(355): /replace="Asp" or " "
  VARIANT (356)..(356): /replace="Glu" or " "
  VARIANT (357)..(357): /replace="Asp" or " "
  VARIANT (358)..(362): /replace=" "
  misc_feature (346)..(362): /note="Residues given in the sequence have no preference with respect to those in the annotations for said positions"
  misc_feature (346)..(362): /note="This region may encompass the sequences disclosed as SEQ ID NOS 380-395, 635 or is absent"
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKELQLEESAAEAQDGELDGVSDVPRDLEVVAATPTSLLISWDAPSDDYGYYRITYGETGGNSPVQEFTVPIGKGTATISGLKPGVDYTITVYAVEFPWPHAGYYHRPISINYRTEIEKPSQEDEDEDEDED

SEQ ID NO: 616 - protein, 258 aa, Artificial Sequence
  source: /note="Description of Artificial Sequence: Synthetic polypeptide"
  VARIANT (1)..(10): /replace=" "
  misc_feature (1)..(10): /note="Residues given in the sequence have no preference with respect to those in the annotations for said positions"
  misc_feature (1)..(10): /note="This region may encompass the sequences disclosed as SEQ ID NOS 371-379 or is absent"
  VARIANT (98)..(98): /replace="Gly" or " "
  VARIANT (99)..(99): /replace="Gly" or "Ser" or " "
  VARIANT (100)..(100): /replace="Asp" or "Ser" or "Gly" or " "
  VARIANT (101)..(101): /replace="Asp" or "Cys" or "Gly" or " "
  VARIANT (102)..(102): /replace="Glu" or "Ser" or "Cys" or " "
  VARIANT (103)..(103): /replace="Cys" or "Asp" or " "
  VARIANT (104)..(104): /replace="Glu" or " "
  VARIANT (105)..(105): /replace="Leu" or "Asp" or " "
  VARIANT (106)..(106): /replace="Glu" or " "
  VARIANT (107)..(107): /replace="Asp" or " "
  VARIANT (108)..(108): /replace="Glu" or " "
  VARIANT (109)..(109): /replace="Asp" or " "
  VARIANT (110)..(114): /replace=" "
  misc_feature (98)..(114): /note="This region may encompass the sequences disclosed as SEQ ID NOS 380-395 or is absent"
  VARIANT (115)..(115): /replace="Pro" or "Ser"
  VARIANT (116)..(116): /replace="Ser" or "Ala" or "Thr" or "Pro"
  VARIANT (117)..(117): /replace="Ser" or "Ala" or "Glu" or "Pro" or "Thr"
  VARIANT (118)..(118): /replace="Ser" or "Ala" or "Pro" or "Val" or "Glu" or "Thr"
  VARIANT (119)..(119): /replace="Gly" or "Ala" or "Thr" or "Pro" or " "
  VARIANT (120)..(120): /replace="Ser" or "Ala" or "Glu" or "Pro" or "Thr" or " "
  VARIANT (121)..(121): /replace="Ser" or "Ala" or "Pro" or "Thr" or " "
  VARIANT (122)..(122): /replace="Ser" or "Ala" or "Glu" or "Pro" or " "
  VARIANT (123)..(123): /replace="Ser" or "Gly" or "Ala" or "Glu" or "Pro" or "Thr" or " "
  VARIANT (124)..(124): /replace="Gly" or "Ala" or "Pro" or "Val" or " "
  VARIANT (125)..(125): /replace="Ser" or "Ala" or "Pro" or " "
  VARIANT (126)..(126): /replace="Ser" or "Glu" or "Pro" or "Ala" or " "
  VARIANT (127)..(127): /replace="Ser" or "Pro" or " "
  VARIANT (128)..(128): /replace="Ser" or "Ala" or " "
  VARIANT (129)..(129): /replace="Glu" or "Pro" or " "
  VARIANT (130)..(130): /replace="Ala" or " "
  VARIANT (131)..(131): /replace="Pro" or " "
  VARIANT (132)..(132): /replace="Ala" or " "
  VARIANT (133)..(149): /replace=" "
  misc_feature (115)..(149): /note="This region may encompass the sequences disclosed as SEQ ID NOS 396-419"
  VARIANT (150)..(159): /replace=" "
  misc_feature (150)..(159): /note="This region may encompass the sequences disclosed as SEQ ID NOS 371-379 or is absent"
  misc_feature (98)..(159): /note="Residues given in the sequence have no preference with respect to those in the annotations for said positions"
  VARIANT (242)..(242): /replace="Gly" or " "
  VARIANT (243)..(243): /replace="Gly" or "Ser" or " "
  VARIANT (244)..(244): /replace="Asp" or "Ser" or "Gly" or " "
  VARIANT (245)..(245): /replace="Asp" or "Cys" or "Gly" or " "
  VARIANT (246)..(246): /replace="Glu" or "Ser" or "Cys" or " "
  VARIANT (247)..(247): /replace="Cys" or "Asp" or " "
  VARIANT (248)..(248): /replace="Glu" or " "
  VARIANT (249)..(249): /replace="Leu" or "Asp" or " "
  VARIANT (250)..(250): /replace="Glu" or " "
  VARIANT (251)..(251): /replace="Asp" or " "
  VARIANT (252)..(252): /replace="Glu" or " "
  VARIANT (253)..(253): /replace="Asp" or " "
  VARIANT (254)..(258): /replace=" "
  misc_feature (242)..(258): /note="Residues given in the sequence have no preference with respect to those in the annotations for said positions"
  misc_feature (242)..(258): /note="This region may encompass the sequences disclosed as SEQ ID NOS 380-395 or is not present"
MGVSDVPRDLEVVAATPTSLLISWVPPSDDYGYYRITYGETGGNSPVQEFTVPIGKGTATISGLKPGVDYTITVYAVEFPWPHAGYYHRPISINYRTEIEKPSQEDEDEDEDEDGGGGSGGGGSGGGGSGGGGSGGGGSGGGGSGGGGSMGVSDVPRDLEVVAATPTSLLISWHSYYEQNSYYRITYGETGGNSPVQEFTVPYSQTTATISGLKPGVDYTITVYAVYGSKYYYPISINYRTEIEKPSQEDEDEDEDED

SEQ ID NO: 617 - protein, 258 aa, Artificial Sequence
  source: /note="Description of Artificial Sequence: Synthetic polypeptide"
  VARIANT (1)..(10): /replace=" "
  misc_feature (1)..(10): /note="Residues given in the sequence have no preference with respect to those in the annotations for said positions"
  misc_feature (1)..(10): /note="This region may encompass the sequences disclosed as SEQ ID NOS 371-379 or is absent"
  VARIANT (93)..(93): /replace="Gly" or " "
  VARIANT (94)..(94): /replace="Gly" or "Ser" or " "
  VARIANT (95)..(95): /replace="Asp" or "Ser" or "Gly" or " "
  VARIANT (96)..(96): /replace="Asp" or "Cys" or "Gly" or " "
  VARIANT (97)..(97): /replace="Glu" or "Ser" or "Cys" or " "
  VARIANT (98)..(98): /replace="Cys" or "Asp" or " "
  VARIANT (99)..(99): /replace="Glu" or " "
  VARIANT (100)..(100): /replace="Leu" or "Asp" or " "
  VARIANT (101)..(101): /replace="Glu" or " "
  VARIANT (102)..(102): /replace="Asp" or " "
  VARIANT (103)..(103): /replace="Glu" or " "
  VARIANT (104)..(104): /replace="Asp" or " "
  VARIANT (105)..(109): /replace=" "
  misc_feature (93)..(109): /note="This region may encompass the sequences disclosed as SEQ ID NOS 380-395 or is absent"
  VARIANT (110)..(110): /replace="Pro" or "Ser"
  VARIANT (111)..(111): /replace="Ser" or "Ala" or "Thr" or "Pro"
  VARIANT (112)..(112): /replace="Ser" or "Ala" or "Glu" or "Pro" or "Thr"
  VARIANT (113)..(113): /replace="Ser" or "Ala" or "Pro" or "Val" or "Glu" or "Thr"
  VARIANT (114)..(114): /replace="Gly" or "Ala" or "Thr" or "Pro" or " "
  VARIANT (115)..(115): /replace="Ser" or "Ala" or "Glu" or "Pro" or "Thr" or " "
  VARIANT (116)..(116): /replace="Ser" or "Ala" or "Pro" or "Thr" or " "
  VARIANT (117)..(117): /replace="Ser" or "Ala" or "Glu" or "Pro" or " "
  VARIANT (118)..(118): /replace="Ser" or "Gly" or "Ala" or "Glu" or "Pro" or "Thr" or " "
  VARIANT (119)..(119): /replace="Gly" or "Ala" or "Pro" or "Val" or " "
  VARIANT (120)..(120): /replace="Ser" or "Ala" or "Pro" or " "
  VARIANT (121)..(121): /replace="Ser" or "Glu" or "Pro" or "Ala" or " "
  VARIANT (122)..(122): /replace="Ser" or "Pro" or " "
  VARIANT (123)..(123): /replace="Ser" or "Ala" or " "
  VARIANT (124)..(124): /replace="Glu" or "Pro" or " "
  VARIANT (125)..(125): /replace="Ala" or " "
  VARIANT (126)..(126): /replace="Pro" or " "
  VARIANT (127)..(127): /replace="Ala" or " "
  VARIANT (128)..(144): /replace=" "
  VARIANT (145)..(154): /replace=" "
  misc_feature (145)..(154): /note="This region may encompass the sequences disclosed as SEQ ID NOS 371-379 or is absent"
  misc_feature (93)..(154): /note="Residues given in the sequence have no preference with respect to those in the annotations for said positions"
  VARIANT (242)..(242): /replace="Gly" or " "
  VARIANT (243)..(243): /replace="Gly" or "Ser" or " "
  VARIANT (244)..(244): /replace="Asp" or "Ser" or "Gly" or " "
  VARIANT (245)..(245): /replace="Asp" or "Cys" or "Gly" or " "
  VARIANT (246)..(246): /replace="Glu" or "Ser" or "Cys" or " "
  VARIANT (247)..(247): /replace="Cys" or "Asp" or " "
  VARIANT (248)..(248): /replace="Glu" or " "
  VARIANT (249)..(249): /replace="Leu" or "Asp" or " "
  VARIANT (250)..(250): /replace="Glu" or " "
  VARIANT (251)..(251): /replace="Asp" or " "
  VARIANT (252)..(252): /replace="Glu" or " "
  VARIANT (253)..(253): /replace="Asp" or " "
  VARIANT (254)..(258): /replace=" "
  misc_feature (242)..(258): /note="Residues given in the sequence have no preference with respect to those in the annotations for said positions"
  misc_feature (242)..(258): /note="This region may encompass the sequences disclosed as SEQ ID NOS 380-395 or is absent"
MGVSDVPRDLEVVAATPTSLLISWHSYYEQNSYYRITYGETGGNSPVQEFTVPYSQTTATISGLKPGVDYTITVYAVYGSKYYYPISINYRTEIEKPSQEDEDEDEDEDGGGGSGGGGSGGGGSGGGGSGGGGSGGGGSGGGGSMGVSDVPRDLEVVAATPTSLLISWVPPSDDYGYYRITYGETGGNSPVQEFTVPIGKGTATISGLKPGVDYTITVYAVEFPWPHAGYYHRPISINYRTEIEKPSQEDEDEDEDED

SEQ ID NO: 618-619 - skipped (2 entries)

SEQ ID NO: 620 - protein, 8 aa, Artificial Sequence
  source: /note="Description of Artificial Sequence: Synthetic peptide"
KAGGGGSG

SEQ ID NO: 621 - protein, 13 aa, Artificial Sequence
  source: /note="Description of Artificial Sequence: Synthetic peptide"
KGSGSGSGSGSGS

SEQ ID NO: 622 - protein, 9 aa, Artificial Sequence
  source: /note="Description of Artificial Sequence: Synthetic peptide"
KQPDEPGGS

SEQ ID NO: 623 - protein, 18 aa, Artificial Sequence
  source: /note="Description of Artificial Sequence: Synthetic peptide"
KELQLEESAAEAQDGELD

SEQ ID NO: 624 - protein, 7 aa, Artificial Sequence
  source: /note="Description of Artificial Sequence: Synthetic peptide"
KTVAAPS

SEQ ID NO: 625 - protein, 9 aa, Artificial Sequence
  source: /note="Description of Artificial Sequence: Synthetic peptide"
KAGGGGSGG

SEQ ID NO: 626 - protein, 14 aa, Artificial Sequence
  source: /note="Description of Artificial Sequence: Synthetic peptide"
KGSGSGSGSGSGSG

SEQ ID NO: 627 - protein, 10 aa, Artificial Sequence
  source: /note="Description of Artificial Sequence: Synthetic peptide"
KQPDEPGGSG

SEQ ID NO: 628 - protein, 19 aa, Artificial Sequence
  source: /note="Description of Artificial Sequence: Synthetic peptide"
KELQLEESAAEAQDGELDG

SEQ ID NO: 629 - protein, 8 aa, Artificial Sequence
  source: /note="Description of Artificial Sequence: Synthetic peptide"
KTVAAPSG

SEQ ID NO: 630 - protein, 8 aa, Artificial Sequence
  source: /note="Description of Artificial Sequence: Synthetic peptide"
AGGGGSGG

SEQ ID NO: 631 - protein, 13 aa, Artificial Sequence
  source: /note="Description of Artificial Sequence: Synthetic peptide"
GSGSGSGSGSGSG

SEQ ID NO: 632 - protein, 9 aa, Artificial Sequence
  source: /note="Description of Artificial Sequence: Synthetic peptide"
QPDEPGGSG

SEQ ID NO: 633 - protein, 18 aa, Artificial Sequence
  source: /note="Description of Artificial Sequence: Synthetic peptide"
ELQLEESAAEAQDGELDG

SEQ ID NO: 634 - protein, 7 aa, Artificial Sequence
  source: /note="Description of Artificial Sequence: Synthetic peptide"
TVAAPSG

SEQ ID NO: 635 - protein, 4 aa, Artificial Sequence
  source: /note="Description of Artificial Sequence: Synthetic peptide"
EIEK

SEQ ID NO: 636 - protein, 5 aa, Homo sapiens
INYRT

SEQ ID NO: 637 - protein, 6 aa, Artificial Sequence
  source: /note="Description of Artificial Sequence: Synthetic 6xHis tag"
HHHHHH

SEQ ID NO: 638 - protein, 8 aa, Artificial Sequence
  source: /note="Description of Artificial Sequence: Synthetic peptide"
HSYYEQNS

SEQ ID NO: 639 - protein, 4 aa, Artificial Sequence
  source: /note="Description of Artificial Sequence: Synthetic peptide"
YSQT

SEQ ID NO: 640 - protein, 7 aa, Artificial Sequence
  source: /note="Description of Artificial Sequence: Synthetic peptide"
YGSKYYY

SEQ ID NO: 641 - protein, 10 aa, Artificial Sequence
  source: /note="Description of Artificial Sequence: Synthetic peptide"
SWHSYYEQNS

SEQ ID NO: 642 - protein, 6 aa, Artificial Sequence
  source: /note="Description of Artificial Sequence: Synthetic peptide"
PYSQTT

SEQ ID NO: 643 - protein, 8 aa, Artificial Sequence
  source: /note="Description of Artificial Sequence: Synthetic peptide"
YGSKYYYP

We claim:

1. An isolated polypeptide comprising a fibronectin type III tenth ($^{10}$Fn3) domain wherein the $^{10}$Fn3 has a BC, DE and FG loop, and wherein the BC loop comprises SEQ ID NO:14, the DE comprises SEQ ID NO:25 and the FG loop comprises SEQ ID NO:37, and wherein the polypeptide binds proprotein convertase subtilisin kexin type (PCSK9).

2. The isolated polypeptide of claim 1, wherein the polypeptide binds PCSK9 with a $K_D$ of less than 500 nM.

3. The isolated polypeptide of claim 1, further comprising one or more pharmacokinetic (PK) moieties selected from the group consisting of polyethylene glycol, sialic acid, Fc, Fc fragment, transferring, serum albumin, a serum albumin binding protein, and a serum immunoglobulin binding protein.

4. A pharmaceutically acceptable composition comprising the polypeptide of claim 1.

5. An isolated polypeptide comprising a $^{10}$Fn3 domain wherein the isolated polypeptide comprises SEQ ID NO:82, and wherein the isolated polypeptide binds PCSK9.

6. The isolated polypeptide of claim 5, wherein the polypeptide binds PCSK9 with a $K_D$ of less than 500 nM.

7. The isolated polypeptide of claim 5, further comprising one or more pharmacokinetic (PK) moieties selected from the group consisting of polyethylene glycol, sialic acid, Fc, Fc fragment, transferring, serum albumin, a serum albumin binding protein, and a serum immunoglobulin binding protein.

8. A pharmaceutically acceptable composition comprising the polypeptide of claim 5.

* * * * *

UNITED STATES PATENT AND TRADEMARK OFFICE
CERTIFICATE OF CORRECTION

PATENT NO. : 8,420,098 B2
APPLICATION NO. : 13/085864
DATED : April 16, 2013
INVENTOR(S) : Ray Camphausen et al.

It is certified that error appears in the above-identified patent and that said Letters Patent is hereby corrected as shown below:

On the Title Page:

Column 2, Item (74)

Line 1, "Paul D. Gollian;" should read -- Paul D. Golian; --.

Signed and Sealed this
Tenth Day of September, 2013

Teresa Stanek Rea
*Acting Director of the United States Patent and Trademark Office*